(12) United States Patent
Takeuchi et al.

(10) Patent No.: US 10,995,328 B2
(45) Date of Patent: May 4, 2021

(54) MATERIALS AND METHODS FOR TREATMENT OF AUTOSOMAL DOMINANT CONE-ROD DYSTROPHY

(71) Applicants: CRISPR THERAPEUTICS AG, Zug (CH); BAYER HEALTHCARE LLC, Whippany, NJ (US)

(72) Inventors: Ryo Takeuchi, Cambridge, MA (US); Akiko Noma, Cambridge, MA (US); Shuying He, Cambridge, MA (US); Abraham Scaria, Cambridge, MA (US)

(73) Assignees: CRISPR THERAPEUTICS AG, Zug (CH); BAYER HEALTHCARE LLC, Whippany, NJ (US)

(*) Notice: Subject to any disclaimer, the term of this patent is extended or adjusted under 35 U.S.C. 154(b) by 0 days.

(21) Appl. No.: 16/899,717

(22) Filed: Jun. 12, 2020

(65) Prior Publication Data

US 2020/0385696 A1  Dec. 10, 2020

Related U.S. Application Data

(63) Continuation of application No. PCT/IB2018/060138, filed on Dec. 14, 2018.

(60) Provisional application No. 62/693,100, filed on Jul. 2, 2018, provisional application No. 62/675,306, filed on May 23, 2018, provisional application No. 62/670,378, filed on May 11, 2018, provisional application No. 62/598,682, filed on Dec. 14, 2017.

(51) Int. Cl.
| | |
|---|---|
| *C12N 9/22* | (2006.01) |
| *C12N 15/11* | (2006.01) |
| *C12N 15/90* | (2006.01) |
| *A61K 38/00* | (2006.01) |

(52) U.S. Cl.
CPC ............ *C12N 9/22* (2013.01); *C12N 15/11* (2013.01); *C12N 15/907* (2013.01); *A61K 38/00* (2013.01); *C12N 2310/20* (2017.05); *C12N 2800/80* (2013.01)

(58) Field of Classification Search
CPC ....... C12N 9/22; C12N 15/11; C12N 2310/20
See application file for complete search history.

(56) References Cited

FOREIGN PATENT DOCUMENTS

| WO | 2018/227114 A1 | 12/2018 |
|---|---|---|
| WO | 2019/046341 A2 | 3/2019 |

OTHER PUBLICATIONS

Boye, S. et al., "Abstracts, 20th Annual Meeting of the American-Society-of-Gene-and-Cell-Therapy (ASGCT); Washington, DC, USA; May 10-13, 2017," Molecular Therapy: The Journal of the American Society of Gene Therapy, vol. 25:1-363 (2017).
Dizhoor, A. et al., "The R838S Mutation in Retinal Guanylyl Cyclase 1 (RetGC1) Alters Calcium Sensitivity of cGMP Synthesis in the Retina and Causes Blindness in Transgenic Mice," Journal of Biological Chemistry, vol. 291(47): 24504-24516 (2016).
International Preliminary Report on Patentability, PCT/IB2018/060138, dated Jun. 16, 2020, 8 pages.
International Search Report and Written Opinion, PCT/IB2018/060138, dated Apr. 16, 2019, 12 pages.
McCullough, K.T. et al., "Somatic Gene Editing of GUCY2D by AAV-CRISPR/Cas9 Alters Retinal Structure and Function in Mouse and Macaque," Human Gene Therapy, vol. 30 (5):19 pages (2018).
Sanjana, N. et al., "Improved vectors and genome-wide libraries for CRISPR screening", Nature Methods, vol. 11(8): 783-784 (2014).
Wilkie, S. et al., "Functional characterization of missense mutations at codon 838 in retinal guanylate cyclase correlates with disease severity in patients with autosomal dominant cone-rod dystrophy," Human Molecular Genetics, vol. 9 (20):3065-3073 (2000).

*Primary Examiner* — Antonio Galisteo Gonzalez
(74) *Attorney, Agent, or Firm* — Marshall, Gerstein & Borun LLP

(57) ABSTRACT

The present application provides materials and methods for treating a patient with autosomal dominant CORD, both ex vivo and in vivo; materials and methods for editing a GUCY2D gene in a human cell; and materials and methods for editing a R838H, R838C, or R838S mutation in a GUCY2D gene in a human cell. The present application also provides one or more gRNAs or sgRNAs for editing a GUCY2D gene; one or more gRNAs or sgRNAs for editing a R838H, R838C, or R838S mutation in a GUCY2D gene; and a therapeutic comprising at least one or more gRNAs or sgRNAs for editing a R838H, R838C, or R838S mutation in a GUCY2D gene. The present application provides a therapeutic for treating a patient with autosomal dominant CORD. The present application also provides a kit for treating a patient with autosomal dominant CORD. In addition, the present application provides a self-inactivating CRISPR-Cas system.

16 Claims, 41 Drawing Sheets

Specification includes a Sequence Listing.

FIGURE 2A

| Target | Guide RNA Name | gRNA sequence | SEQ ID NO. |
|---|---|---|---|
| WT GUCY2D | WT_Sa_T1 | UCCAGCUCCUCCGUGCGCUC | 5272 |
| WT GUCY2D | WT19mer_Sa_T1 | CCAGCUCCUCCGUGCGCUC | 5273 |
| WT GUCY2D | WT_Sp_T1 | UCUGAUCCGGGAGCGCACGG | 5274 |
| WT GUCY2D | WT_Sp_T2 | GGAUCUGAUCCGGGAGCGCA | 5275 |
| WT GUCY2D | WT_Sp_T3 | CCAGCUCCUCCGUGCGCUCC | 5276 |
| WT GUCY2D | WT_Sp_T4 | CCGGGAGCGCACGGAGGAGC | 5277 |
| WT GUCY2D | WT19mer_Sp_T1 | CUGAUCCGGGAGCGCACGG | 5278 |
| WT GUCY2D | WT19mer_Sp_T2 | GAUCUGAUCCGGGAGCGCA | 5279 |
| WT GUCY2D | WT19mer_Sp_T3 | CAGCUCCUCCGUGCGCUCC | 5280 |
| WT GUCY2D | WT19mer_Sp_T4 | CGGGAGCGCACGGAGGAGC | 5281 |
| Mut (R838H) GUCY2D | R838H_Sa_T1 | UCCAGCUCCUCCGUGUGCUC | 5282 |
| Mut (R838H) GUCY2D | R838H19mer_Sa_T1 | CCAGCUCCUCCGUGUGCUC | 5283 |
| Mut (R838H) GUCY2D | R838H_Sp_T1 | UCUGAUCCGGGAGCACACGG | 5284 |
| Mut (R838H) GUCY2D | R838H_Sp_T2 | GGAUCUGAUCCGGGAGCACA | 5285 |
| Mut (R838H) GUCY2D | R838H_Sp_T3 | CCAGCUCCUCCGUGUGCUCC | 5286 |
| Mut (R838H) GUCY2D | R838H_Sp_T4 | CCGGGAGCACACGGAGGAGC | 5287 |
| Mut (R838H) GUCY2D | R838H_Sp_T5 | GCACACGGAGGAGCUGGAGC | 5288 |
| Mut (R838H) GUCY2D | R838H19mer_Sp_T1 | CUGAUCCGGGAGCACACGG | 5289 |
| Mut (R838H) GUCY2D | R838H19mer_Sp_T2 | GAUCUGAUCCGGGAGCACA | 5290 |
| Mut (R838H) GUCY2D | R838H19mer_Sp_T3 | CAGCUCCUCCGUGUGCUCC | 5291 |
| Mut (R838H) GUCY2D | R838H19mer_Sp_T4 | CGGGAGCACACGGAGGAGC | 5292 |
| Mut (R838H) GUCY2D | R838H19mer_Sp_T5 | CACACGGAGGAGCUGGAGC | 5293 |
| Mut (R838C) GUCY2D | R838C_Sa_T1 | UCCAGCUCCUCCGUGCACUC | 5294 |
| Mut (R838C) GUCY2D | R838C19mer_Sa_T1 | CCAGCUCCUCCGUGCACUC | 5295 |
| Mut (R838C) GUCY2D | R838C_Sp_T1 | UCUGAUCCGGGAGUGCACGG | 5296 |
| Mut (R838C) GUCY2D | R838C_Sp_T2 | GGAUCUGAUCCGGGAGUGCA | 5297 |
| Mut (R838C) GUCY2D | R838C_Sp_T3 | CCAGCUCCUCCGUGCACUCC | 5298 |
| Mut (R838C) GUCY2D | R838C_Sp_T4 | CCGGGAGUGCACGGAGGAGC | 5299 |
| Mut (R838C) GUCY2D | R838C19mer_Sp_T1 | GAUCUGAUCCGGGAGUGCA | 5300 |
| Mut (R838C) GUCY2D | R838C19mer_Sp_T2 | CUGAUCCGGGAGUGCACGG | 5301 |
| Mut (R838C) GUCY2D | R838C19mer_Sp_T3 | CAGCUCCUCCGUGCACUCC | 5302 |
| Mut (R838C) GUCY2D | R838C19mer_Sp_T4 | CGGGAGUGCACGGAGGAGC | 5303 |
| Mut (R838S) GUCY2D | R838S_Sp_T1 | UCUGAUCCGGGAGAGCACGG | 5304 |
| Mut (R838S) GUCY2D | R838S_Sp_T2 | GGAUCUGAUCCGGGAGAGCA | 5305 |
| Mut (R838S) GUCY2D | R838S_Sp_T3 | CCAGCUCCUCCGUGCUCUCC | 5306 |
| Mut (R838S) GUCY2D | R838S_Sp_T4 | CCGGGAGAGCACGGAGGAGC | 5307 |
| Mut (R838S) GUCY2D | R838S19mer_Sp_T1 | GAUCUGAUCCGGGAGAGCA | 5308 |
| Mut (R838S) GUCY2D | R838S19mer_Sp_T2 | CUGAUCCGGGAGAGCACGG | 5309 |
| Mut (R838S) GUCY2D | R838S19mer_Sp_T3 | CAGCUCCUCCGUGCUCUCC | 5310 |
| Mut (R838S) GUCY2D | R838S19mer_Sp_T4 | CGGGAGAGCACGGAGGAGC | 5311 |
| Mut (R838S) GUCY2D | R838S_Sa_T1 | UCCAGCUCCUCCGUGCUCUC | 5312 |
| Mut (R838S) GUCY2D | R838S19mer_Sa_T1 | CCAGCUCCUCCGUGCUCUC | 5313 |

FIGURE 2B

| Target | Guide RNA Name | Target DNA Sequence (5'-3') | SEQ ID NO: |
|---|---|---|---|
| WT GUCY2D | WT_Sa_T1 | TCCAGCTCCTCCGTGCGCTC | 5314 |
| WT GUCY2D | WT19mer_Sa_T1 | CCAGCTCCTCCGTGCGCTC | 5315 |
| WT GUCY2D | WT_Sp_T1 | TCTGATCCGGGAGCGCACGG | 5316 |
| WT GUCY2D | WT_Sp_T2 | GGATCTGATCCGGGAGCGCA | 5317 |
| WT GUCY2D | WT_Sp_T3 | CCAGCTCCTCCGTGCGCTCC | 5318 |
| WT GUCY2D | WT_Sp_T4 | CCGGGAGCGCACGGAGGAGC | 5319 |
| WT GUCY2D | WT19mer_Sp_T1 | CTGATCCGGGAGCGCACGG | 5320 |
| WT GUCY2D | WT19mer_Sp_T2 | GATCTGATCCGGGAGCGCA | 5321 |
| WT GUCY2D | WT19mer_Sp_T3 | CAGCTCCTCCGTGCGCTCC | 5322 |
| WT GUCY2D | WT19mer_Sp_T4 | CGGGAGCGCACGGAGGAGC | 5323 |
| Mut (R838H) GUCY2D | R838H_Sa_T1 | TCCAGCTCCTCCGTGTGCTC | 5324 |
| Mut (R838H) GUCY2D | R838H19mer_Sa_T1 | CCAGCTCCTCCGTGTGCTC | 5325 |
| Mut (R838H) GUCY2D | R838H_Sp_T1 | TCTGATCCGGGAGCACACGG | 5326 |
| Mut (R838H) GUCY2D | R838H_Sp_T2 | GGATCTGATCCGGGAGCACA | 5327 |
| Mut (R838H) GUCY2D | R838H_Sp_T3 | CCAGCTCCTCCGTGTGCTCC | 5328 |
| Mut (R838H) GUCY2D | R838H_Sp_T4 | CCGGGAGCACACGGAGGAGC | 5329 |
| Mut (R838H) GUCY2D | R838H_Sp_T5 | GCACACGGAGGAGCTGGAGC | 5330 |
| Mut (R838H) GUCY2D | R838H19mer_Sp_T1 | CTGATCCGGGAGCACACGG | 5331 |
| Mut (R838H) GUCY2D | R838H19mer_Sp_T2 | GATCTGATCCGGGAGCACA | 5332 |
| Mut (R838H) GUCY2D | R838H19mer_Sp_T3 | CAGCTCCTCCGTGTGCTCC | 5333 |
| Mut (R838H) GUCY2D | R838H19mer_Sp_T4 | CGGGAGCACACGGAGGAGC | 5334 |
| Mut (R838H) GUCY2D | R838H19mer_Sp_T5 | CACACGGAGGAGCTGGAGC | 5335 |
| Mut (R838C) GUCY2D | R838C_Sa_T1 | TCCAGCTCCTCCGTGCACTC | 5336 |
| Mut (R838C) GUCY2D | R838C19mer_Sa_T1 | CCAGCTCCTCCGTGCACTC | 5337 |
| Mut (R838C) GUCY2D | R838C_Sp_T1 | TCTGATCCGGGAGTGCACGG | 5338 |
| Mut (R838C) GUCY2D | R838C_Sp_T2 | GGATCTGATCCGGGAGTGCA | 5339 |
| Mut (R838C) GUCY2D | R838C_Sp_T3 | CCAGCTCCTCCGTGCACTCC | 5340 |
| Mut (R838C) GUCY2D | R838C_Sp_T4 | CCGGGAGTGCACGGAGGAGC | 5341 |
| Mut (R838C) GUCY2D | R838C19mer_Sp_T1 | GATCTGATCCGGGAGTGCA | 5342 |
| Mut (R838C) GUCY2D | R838C19mer_Sp_T2 | CTGATCCGGGAGTGCACGG | 5343 |
| Mut (R838C) GUCY2D | R838C19mer_Sp_T3 | CAGCTCCTCCGTGCACTCC | 5344 |
| Mut (R838C) GUCY2D | R838C19mer_Sp_T4 | CGGGAGTGCACGGAGGAGC | 5345 |
| Mut (R838S) GUCY2D | R838S_Sp_T1 | TCTGATCCGGGAGAGCACGG | 5346 |
| Mut (R838S) GUCY2D | R838S_Sp_T2 | GGATCTGATCCGGGAGAGCA | 5347 |
| Mut (R838S) GUCY2D | R838S_Sp_T3 | CCAGCTCCTCCGTGCTCTCC | 5348 |
| Mut (R838S) GUCY2D | R838S_Sp_T4 | CCGGGAGAGCACGGAGGAGC | 5349 |
| Mut (R838S) GUCY2D | R838S19mer_Sp_T1 | GATCTGATCCGGGAGAGCA | 5350 |
| Mut (R838S) GUCY2D | R838S19mer_Sp_T2 | CTGATCCGGGAGAGCACGG | 5351 |
| Mut (R838S) GUCY2D | R838S19mer_Sp_T3 | CAGCTCCTCCGTGCTCTCC | 5352 |
| Mut (R838S) GUCY2D | R838S19mer_Sp_T4 | CGGGAGAGCACGGAGGAGC | 5353 |
| Mut (R838S) GUCY2D | R838S_Sa_T1 | TCCAGCTCCTCCGTGCTCTC | 5354 |
| Mut (R838S) GUCY2D | R838S19mer_Sa_T1 | CCAGCTCCTCCGTGCTCTC | 5355 |

FIGURE 2C

| Target | Guide RNA Name | Reverse Strand of Target DNA Sequence to which the sgRNA will bind (5'-3') | SEQ ID NO: |
|---|---|---|---|
| WT GUCY2D | WT_Sa_T1 | GAGCGCACGGAGGAGCTGGA | 5356 |
| WT GUCY2D | WT19mer_Sa_T1 | GAGCGCACGGAGGAGCTGG | 5357 |
| WT GUCY2D | WT_Sp_T1 | CCGTGCGCTCCCGGATCAGA | 5358 |
| WT GUCY2D | WT_Sp_T2 | TGCGCTCCCGGATCAGATCC | 5359 |
| WT GUCY2D | WT_Sp_T3 | GGAGCGCACGGAGGAGCTGG | 5360 |
| WT GUCY2D | WT_Sp_T4 | GCTCCTCCGTGCGCTCCCGG | 5361 |
| WT GUCY2D | WT19mer_Sp_T1 | CCGTGCGCTCCCGGATCAG | 5362 |
| WT GUCY2D | WT19mer_Sp_T2 | TGCGCTCCCGGATCAGATC | 5363 |
| WT GUCY2D | WT19mer_Sp_T3 | GGAGCGCACGGAGGAGCTG | 5364 |
| WT GUCY2D | WT19mer_Sp_T4 | GCTCCTCCGTGCGCTCCCG | 5365 |
| Mut (R838H) GUCY2D | R838H_Sa_T1 | GAGCACACGGAGGAGCTGGA | 5366 |
| Mut (R838H) GUCY2D | R838H19mer_Sa_T1 | GAGCACACGGAGGAGCTGG | 5367 |
| Mut (R838H) GUCY2D | R838H_Sp_T1 | CCGTGTGCTCCCGGATCAGA | 5368 |
| Mut (R838H) GUCY2D | R838H_Sp_T2 | TGTGCTCCCGGATCAGATCC | 5369 |
| Mut (R838H) GUCY2D | R838H_Sp_T3 | GGAGCACACGGAGGAGCTGG | 5370 |
| Mut (R838H) GUCY2D | R838H_Sp_T4 | GCTCCTCCGTGTGCTCCCGG | 5371 |
| Mut (R838H) GUCY2D | R838H_Sp_T5 | GCTCCAGCTCCTCCGTGTGC | 5372 |
| Mut (R838H) GUCY2D | R838H19mer_Sp_T1 | CCGTGTGCTCCCGGATCAG | 5373 |
| Mut (R838H) GUCY2D | R838H19mer_Sp_T2 | TGTGCTCCCGGATCAGATC | 5374 |
| Mut (R838H) GUCY2D | R838H19mer_Sp_T3 | GGAGCACACGGAGGAGCTG | 5375 |
| Mut (R838H) GUCY2D | R838H19mer_Sp_T4 | GCTCCTCCGTGTGCTCCCG | 5376 |
| Mut (R838H) GUCY2D | R838H19mer_Sp_T5 | GCTCCAGCTCCTCCGTGTG | 5377 |
| Mut (R838C) GUCY2D | R838C_Sa_T1 | GAGTGCACGGAGGAGCTGGA | 5378 |
| Mut (R838C) GUCY2D | R838C19mer_Sa_T1 | GAGTGCACGGAGGAGCTGG | 5379 |
| Mut (R838C) GUCY2D | R838C_Sp_T1 | CCGTGCACTCCCGGATCAGA | 5380 |
| Mut (R838C) GUCY2D | R838C_Sp_T2 | TGCACTCCCGGATCAGATCC | 5381 |
| Mut (R838C) GUCY2D | R838C_Sp_T3 | GGAGTGCACGGAGGAGCTGG | 5382 |
| Mut (R838C) GUCY2D | R838C_Sp_T4 | GCTCCTCCGTGCACTCCCGG | 5383 |
| Mut (R838C) GUCY2D | R838C19mer_Sp_T1 | TGCACTCCCGGATCAGATC | 5384 |
| Mut (R838C) GUCY2D | R838C19mer_Sp_T2 | CCGTGCACTCCCGGATCAG | 5385 |
| Mut (R838C) GUCY2D | R838C19mer_Sp_T3 | GGAGTGCACGGAGGAGCTG | 5386 |
| Mut (R838C) GUCY2D | R838C19mer_Sp_T4 | GCTCCTCCGTGCACTCCCG | 5387 |
| Mut (R838S) GUCY2D | R838S_Sp_T1 | CCGTGCTCTCCCGGATCAGA | 5388 |
| Mut (R838S) GUCY2D | R838S_Sp_T2 | TGCTCTCCCGGATCAGATCC | 5389 |
| Mut (R838S) GUCY2D | R838S_Sp_T3 | GGAGAGCACGGAGGAGCTGG | 5390 |
| Mut (R838S) GUCY2D | R838S_Sp_T4 | GCTCCTCCGTGCTCTCCCGG | 5391 |
| Mut (R838S) GUCY2D | R838S19mer_Sp_T1 | TGCTCTCCCGGATCAGATC | 5392 |
| Mut (R838S) GUCY2D | R838S19mer_Sp_T2 | CCGTGCTCTCCCGGATCAG | 5393 |
| Mut (R838S) GUCY2D | R838S19mer_Sp_T3 | GGAGAGCACGGAGGAGCTG | 5394 |
| Mut (R838S) GUCY2D | R838S19mer_Sp_T4 | GCTCCTCCGTGCTCTCCCG | 5395 |
| Mut (R838S) GUCY2D | R838S_Sa_T1 | GAGAGCACGGAGGAGCTGGA | 5396 |
| Mut (R838S) GUCY2D | R838S19mer_Sa_T1 | GAGAGCACGGAGGAGCTGG | 5397 |

FIGURE 2D

| Target | Guide RNA Name | sgRNA sequence | SEQ ID NO: |
|---|---|---|---|
| Mut (R838CH) GUCY2D | R838CH_Sp_T1 | UCUGAUCCGGGAGUACACGG | 5398 |
| Mut (R838CH) GUCY2D | R838CH_Sp_T2 | GGAUCUGAUCCGGGAGUACA | 5399 |
| Mut (R838CH) GUCY2D | R838CH_Sp_T3 | CCAGCUCCUCCGUGUACUCC | 5400 |
| Mut (R838CH) GUCY2D | R838CH_Sp_T4 | GUACACGGAGGAGCUGGAGC | 5401 |
| Mut (R838CH) GUCY2D | R838CH_Sp_T5 | CCGGGAGUACACGGAGGAGC | 5402 |
| Mut (R838CH) GUCY2D | R838CH19mer_Sp_T1 | CUGAUCCGGGAGUACACGG | 5403 |
| Mut (R838CH) GUCY2D | R838CH19mer_Sp_T2 | GAUCUGAUCCGGGAGUACA | 5404 |
| Mut (R838CH) GUCY2D | R838CH19mer_Sp_T3 | CAGCUCCUCCGUGUACUCC | 5405 |
| Mut (R838CH) GUCY2D | R838CH19mer_Sp_T4 | UACACGGAGGAGCUGGAGC | 5406 |
| Mut (R838CH) GUCY2D | R838CH19mer_Sp_T5 | CGGGAGUACACGGAGGAGC | 5407 |
| Mut (R838CH) GUCY2D | R838CH_Sa_T1 | UCCAGCUCCUCCGUGUACUC | 5408 |
| Mut (R838CH) GUCY2D | R838CH19mer_Sa_T1 | CCAGCUCCUCCGUGUACUC | 5409 |
| Mut (R838SH) GUCY2D | R838SH_Sa_T1 | UCCAGCUCCUCCGUGUUCUC | 5434 |
| Mut (R838SH) GUCY2D | R838SH19mer_Sa_T1 | CCAGCUCCUCCGUGUUCUC | 5435 |
| Mut (R838SH) GUCY2D | R838SH_Sp_T1 | GGAUCUGAUCCGGGAGAACA | 5436 |
| Mut (R838SH) GUCY2D | R838SH_Sp_T2 | UCUGAUCCGGGAGAACACGG | 5437 |
| Mut (R838SH) GUCY2D | R838SH_Sp_T3 | CCAGCUCCUCCGUGUUCUCC | 5438 |
| Mut (R838SH) GUCY2D | R838SH_Sp_T4 | CCGGGAGAACACGGAGGAGC | 5439 |
| Mut (R838SH) GUCY2D | R838SH19mer_Sp_T1 | CUGAUCCGGGAGAACACGG | 5440 |
| Mut (R838SH) GUCY2D | R838SH19mer_Sp_T2 | GAUCUGAUCCGGGAGAACA | 5441 |
| Mut (R838SH) GUCY2D | R838SH19mer_Sp_T3 | CAGCUCCUCCGUGUUCUCC | 5442 |
| Mut (R838SH) GUCY2D | R838SH19mer_Sp_T4 | CGGGAGAACACGGAGGAGC | 5443 |

FIGURE 2E

| Target | Guide RNA Name | Target DNA Sequence (5'-3') | SEQ ID NO. |
|---|---|---|---|
| Mut (R838CH) GUCY2D | R838CH_Sp_T1 | TCTGATCCGGGAGTACACGG | 5410 |
| Mut (R838CH) GUCY2D | R838CH_Sp_T2 | GGATCTGATCCGGGAGTACA | 5411 |
| Mut (R838CH) GUCY2D | R838CH_Sp_T3 | CCAGCTCCTCCGTGTACTCC | 5412 |
| Mut (R838CH) GUCY2D | R838CH_Sp_T4 | GTACACGGAGGAGCTGGAGC | 5413 |
| Mut (R838CH) GUCY2D | R838CH_Sp_T5 | CCGGGAGTACACGGAGGAGC | 5414 |
| Mut (R838CH) GUCY2D | R838CH19mer_Sp_T1 | CTGATCCGGGAGTACACGG | 5415 |
| Mut (R838CH) GUCY2D | R838CH19mer_Sp_T2 | GATCTGATCCGGGAGTACA | 5416 |
| Mut (R838CH) GUCY2D | R838CH19mer_Sp_T3 | CAGCTCCTCCGTGTACTCC | 5417 |
| Mut (R838CH) GUCY2D | R838CH19mer_Sp_T4 | TACACGGAGGAGCTGGAGC | 5418 |
| Mut (R838CH) GUCY2D | R838CH19mer_Sp_T5 | CGGGAGTACACGGAGGAGC | 5419 |
| Mut (R838CH) GUCY2D | R838CH_Sa_T1 | TCCAGCTCCTCCGTGTACTC | 5420 |
| Mut (R838CH) GUCY2D | R838CH19mer_Sa_T1 | CCAGCTCCTCCGTGTACTC | 5421 |
| Mut (R838SH) GUCY2D | R838SH_Sa_T1 | TCCAGCTCCTCCGTGTTCTC | 5444 |
| Mut (R838SH) GUCY2D | R838SH19mer_Sa_T1 | CCAGCTCCTCCGTGTTCTC | 5445 |
| Mut (R838SH) GUCY2D | R838SH_Sp_T1 | GGATCTGATCCGGGAGAACA | 5446 |
| Mut (R838SH) GUCY2D | R838SH_Sp_T2 | TCTGATCCGGGAGAACACGG | 5447 |
| Mut (R838SH) GUCY2D | R838SH_Sp_T3 | CCAGCTCCTCCGTGTTCTCC | 5448 |
| Mut (R838SH) GUCY2D | R838SH_Sp_T4 | CCGGGAGAACACGGAGGAGC | 5449 |
| Mut (R838SH) GUCY2D | R838SH19mer_Sp_T1 | CTGATCCGGGAGAACACGG | 5450 |
| Mut (R838SH) GUCY2D | R838SH19mer_Sp_T2 | GATCTGATCCGGGAGAACA | 5451 |
| Mut (R838SH) GUCY2D | R838SH19mer_Sp_T3 | CAGCTCCTCCGTGTTCTCC | 5452 |
| Mut (R838SH) GUCY2D | R838SH19mer_Sp_T4 | CGGGAGAACACGGAGGAGC | 5453 |

FIGURE 2F

| Target | Guide RNA Name | Reverse Strand of Target DNA sequence to which the sgRNA will bind (5'-3') | SEQ ID NO: |
|---|---|---|---|
| Mut (R838CH) GUCY2D | R838CH_Sp_T1 | CCGTGTACTCCCGGATCAGA | 5422 |
| Mut (R838CH) GUCY2D | R838CH_Sp_T2 | TGTACTCCCGGATCAGATCC | 5423 |
| Mut (R838CH) GUCY2D | R838CH_Sp_T3 | GGAGTACACGGAGGAGCTGG | 5424 |
| Mut (R838CH) GUCY2D | R838CH_Sp_T4 | GCTCCAGCTCCTCCGTGTAC | 5425 |
| Mut (R838CH) GUCY2D | R838CH_Sp_T5 | GCTCCTCCGTGTACTCCCGG | 5426 |
| Mut (R838CH) GUCY2D | R838CH19mer_Sp_T1 | CCGTGTACTCCCGGATCAG | 5427 |
| Mut (R838CH) GUCY2D | R838CH19mer_Sp_T2 | TGTACTCCCGGATCAGATC | 5428 |
| Mut (R838CH) GUCY2D | R838CH19mer_Sp_T3 | GGAGTACACGGAGGAGCTG | 5429 |
| Mut (R838CH) GUCY2D | R838CH19mer_Sp_T4 | GCTCCAGCTCCTCCGTGTA | 5430 |
| Mut (R838CH) GUCY2D | R838CH19mer_Sp_T5 | GCTCCTCCGTGTACTCCCG | 5431 |
| Mut (R838CH) GUCY2D | R838CH_Sa_T1 | GAGTACACGGAGGAGCTGGA | 5432 |
| Mut (R838CH) GUCY2D | R838CH19mer_Sa_T1 | GAGTACACGGAGGAGCTGG | 5433 |
| Mut (R838SH) GUCY2D | R838SH_Sa_T1 | GAGAACACGGAGGAGCTGGA | 5454 |
| Mut (R838SH) GUCY2D | R838SH19mer_Sa_T1 | GAGAACACGGAGGAGCTGG | 5455 |
| Mut (R838SH) GUCY2D | R838SH_Sp_T1 | TGTTCTCCCGGATCAGATCC | 5456 |
| Mut (R838SH) GUCY2D | R838SH_Sp_T2 | CCGTGTTCTCCCGGATCAGA | 5457 |
| Mut (R838SH) GUCY2D | R838SH_Sp_T3 | GGAGAACACGGAGGAGCTGG | 5458 |
| Mut (R838SH) GUCY2D | R838SH_Sp_T4 | GCTCCTCCGTGTTCTCCCGG | 5459 |
| Mut (R838SH) GUCY2D | R838SH19mer_Sp_T1 | CCGTGTTCTCCCGGATCAG | 5460 |
| Mut (R838SH) GUCY2D | R838SH19mer_Sp_T2 | TGTTCTCCCGGATCAGATC | 5461 |
| Mut (R838SH) GUCY2D | R838SH19mer_Sp_T3 | GGAGAACACGGAGGAGCTG | 5462 |
| Mut (R838SH) GUCY2D | R838SH19mer_Sp_T4 | GCTCCTCCGTGTTCTCCCG | 5463 |

R838C19mer_Sp_T4
CGGGAGTGCACGGAGGAGG (SEQ ID NO: 5345)

R838C_Sp_T4
CCGGGAGTGCACGGAGGAGG (SEQ ID NO: 5341)

R838C19mer_Sp_T2
CTGATCCGGGAGTGCACGG (SEQ ID NO: 5343)

R838C_Sp_T1
TCTGATCCGGGAGTGCACGG (SEQ ID NO: 5338)

R838C19mer_Sp_T1
GATCTGATCCGGGAGTGCA (SEQ ID NO: 5342)

R838C_Sp_T2
GGATCTGATCCGGGAGTGCA (SEQ ID NO: 5339)

5'  TCTAGTAACCTGGAGGATCTGATCCGGGAGTGCACGGAGGAGCTGGAGCTGGAAAAGCAGAA  3'
                                                                   62
3'  AGATCATTGGACCTCCTAGACTAGGCCCTCACGTGCCTCCTCGACCTCGACCTTTTCGTCTT  5' gRNAwindow

CCTCACGTGCCTCCTCGAG (SEQ ID NO: 5344)

R838C19mer_Sp_T3
CCTCACGTGCCTCCTCGACC (SEQ ID NO: 5340)
R838C_Sp_T3

CTCACGTGCCTCCTCGACC (SEQ ID NO: 5337)

R838C19mer_Sa_T1
CTCACGTGCCTCCTCGACCT (SEQ ID NO: 5336)
R838C_Sa_T1

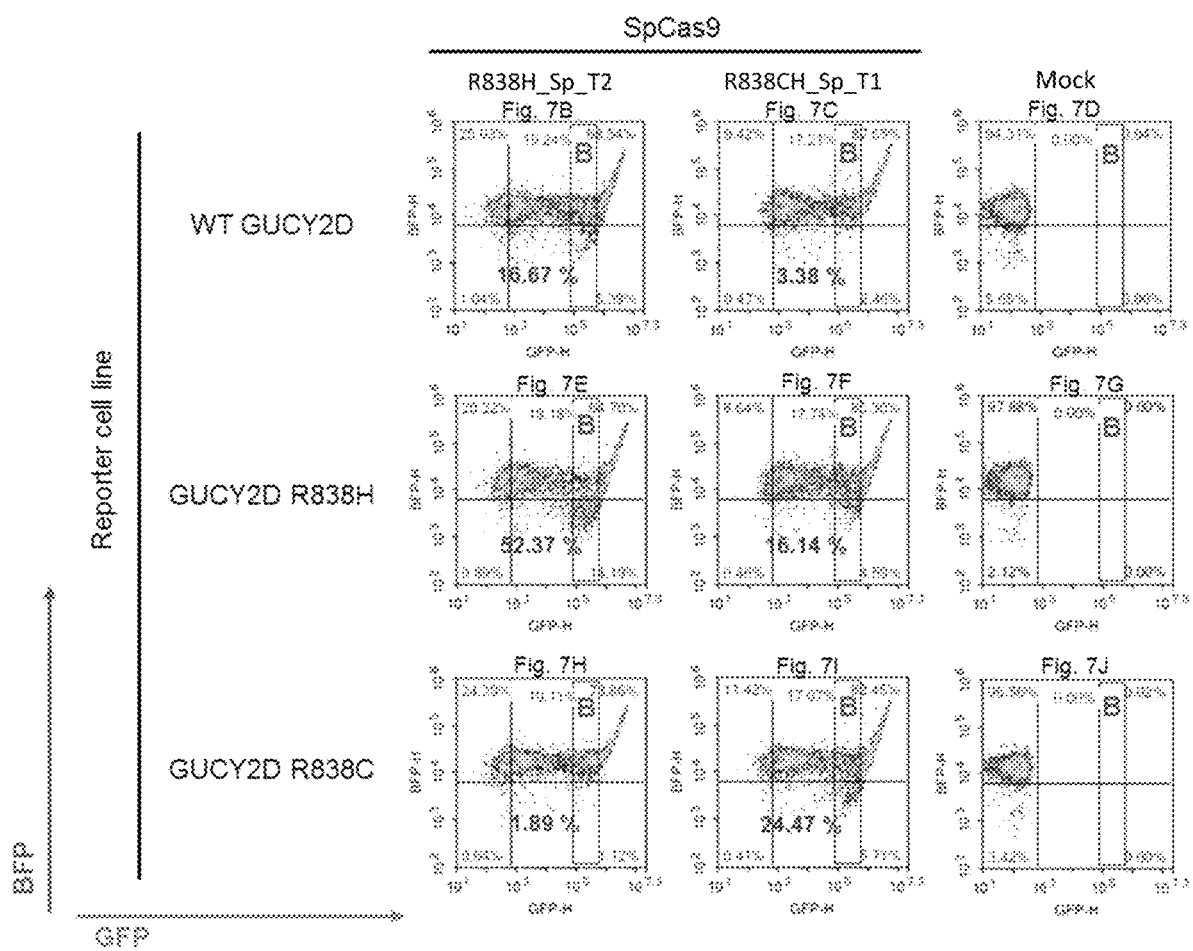

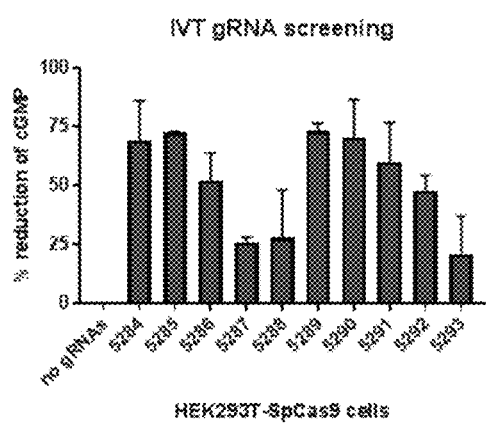

FIGURE 8A

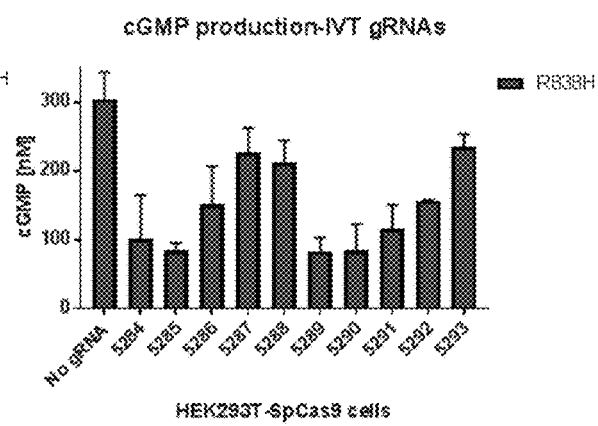

FIGURE 8B

| SEQ ID NO: | Target | Guide RNA sequence | % reduction of cGMP |
|---|---|---|---|
| 5284 | Mut (R838H) GUCY2D | UCUGAUCCGGGAGCACACGG | 69.1 |
| 5285 | Mut (R838H) GUCY2D | GGAUCUGAUCCGGGAGCACA | 72.5 |
| 5286 | Mut (R838H) GUCY2D | CCAGCUCCUCCGUGUGCUCC | 51.9 |
| 5287 | Mut (R838H) GUCY2D | CCGGGAGCACACGGAGGAGC | 25.9 |
| 5288 | Mut (R838H) GUCY2D | GCACACGGAGGAGCUGGAGC | 28.1 |
| 5289 | Mut (R838H) GUCY2D | CUGAUCCGGGAGCACACGG | 73.1 |
| 5290 | Mut (R838H) GUCY2D | GAUCUGAUCCGGGAGCACA | 70.3 |
| 5291 | Mut (R838H) GUCY2D | CAGCUCCUCCGUGUGCUCC | 60.1 |
| 5292 | Mut (R838H) GUCY2D | CGGGAGCACACGGAGGAGC | 47.8 |
| 5293 | Mut (R838H) GUCY2D | CACACGGAGGAGCUGGAGC | 20.9 |

| SEQ ID NO: | Target | Guide RNA sequence | % reduction of cGMP |
|---|---|---|---|
| 5285 | Mut (R838H) GUCY2D | GGAUCUGAUCCGGGAGCACA | 82.7 |
| 5286 | Mut (R838H) GUCY2D | CCAGCUCCUCCGUGUGCUCC | 60.5 |
| 5291 | Mut (R838H) GUCY2D | CAGCUCCUCCGUGUGCUCC | 69.1 |

| SEQ ID NO: | Target | sgRNA sequence | % reduction of cGMP |
|---|---|---|---|
| 5274 | WT GUCY2D | UCUGAUCCGGGAGCGCACGG | 0 |
| 5285 | Mut (R838H) GUCY2D | GGAUCUGAUCCGGGAGCACA | 41.3 |
| 5286 | Mut (R838H) GUCY2D | CCAGCUCCUCCGUGUGCUCC | 16.5 |

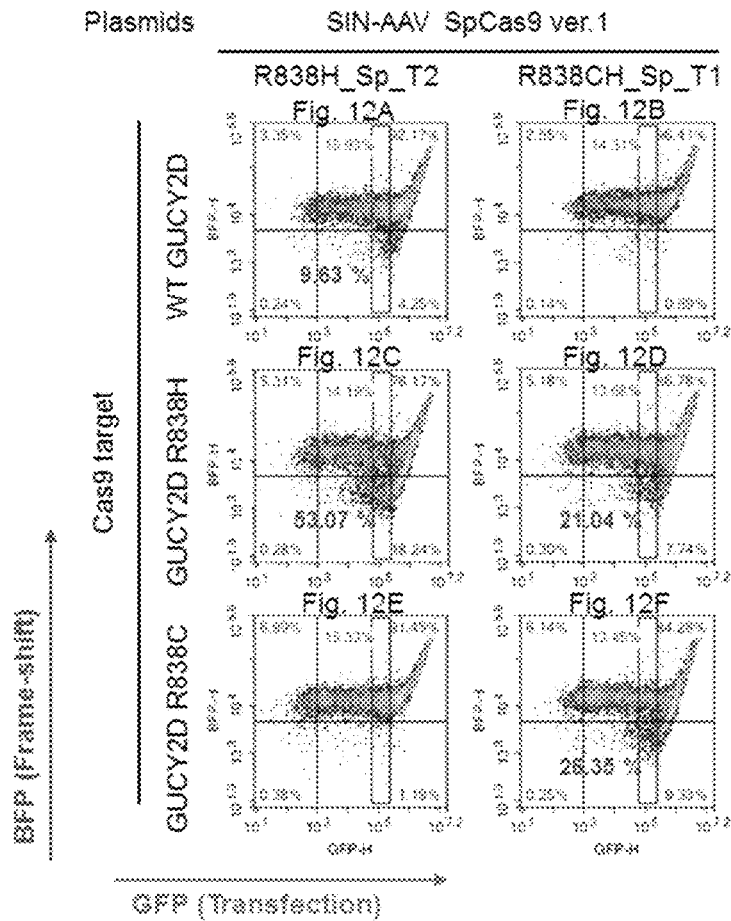
| Guide Name | SEQ ID NO: | | R838 Target site | | SEQ ID NO: |
|---|---|---|---|---|---|
| R838H_Sp_T2 | 5285 | edits → | GGATCTGATCCGGGAGCACA<br>TGTGCTCCCGGATCAGATCC | (located in 5' SIN site)<br>(located in 3' SIN site) | 5327<br>5369 |
| R838CH_Sp_T1 | 5398 | edits → | TCTGATCCGGGAGTACACGG<br>CCGTGTACTCCCGGATCAGA | (located in 5' SIN site)<br>(located in 3' SIN site) | 5326<br>5368 |

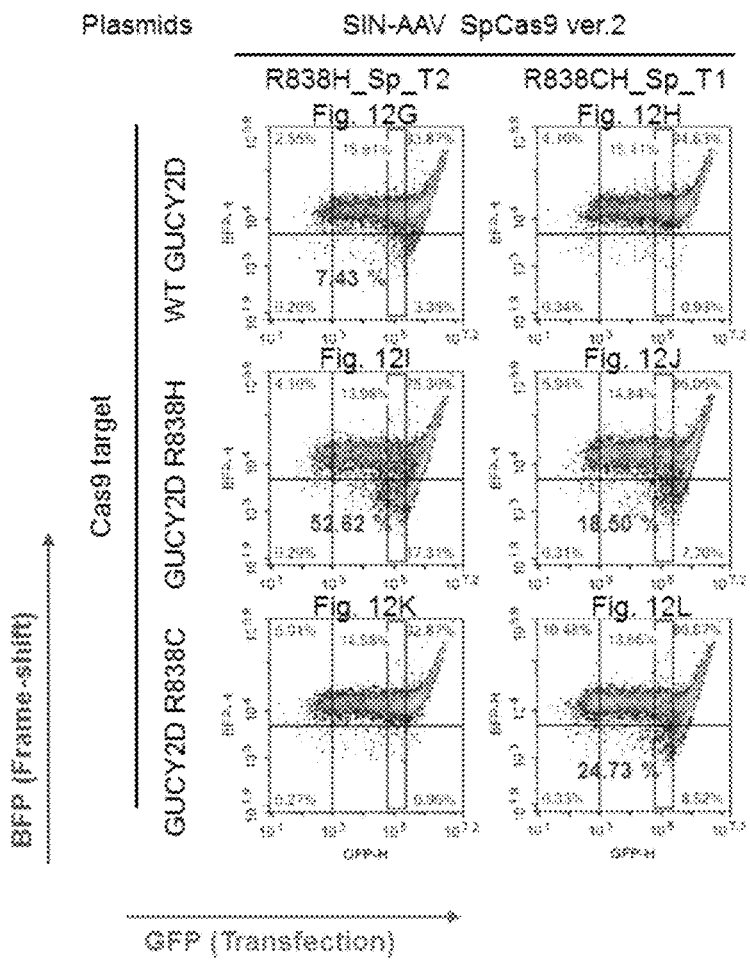
| Guide Name | SEQ ID NO: | | R838 Target site | | SEQ ID NO: |
|---|---|---|---|---|---|
| R838H_Sp_T2 | 5285 | edits → | GGATCTGATCCGGGAGCACA (located in 5' SIN site) <br> TGTGCTCCCGGATCAGATCC (located in 3' SIN site) | | 5327 <br> 5369 |
| R838CH_Sp_T1 | 5398 | edits → | TCTGATCCGGGAGTACACGG (located in 5' SIN site) <br> CCGTGTACTCCCGGATCAGA (located in 3' SIN site) | | 5326 <br> 5368 |

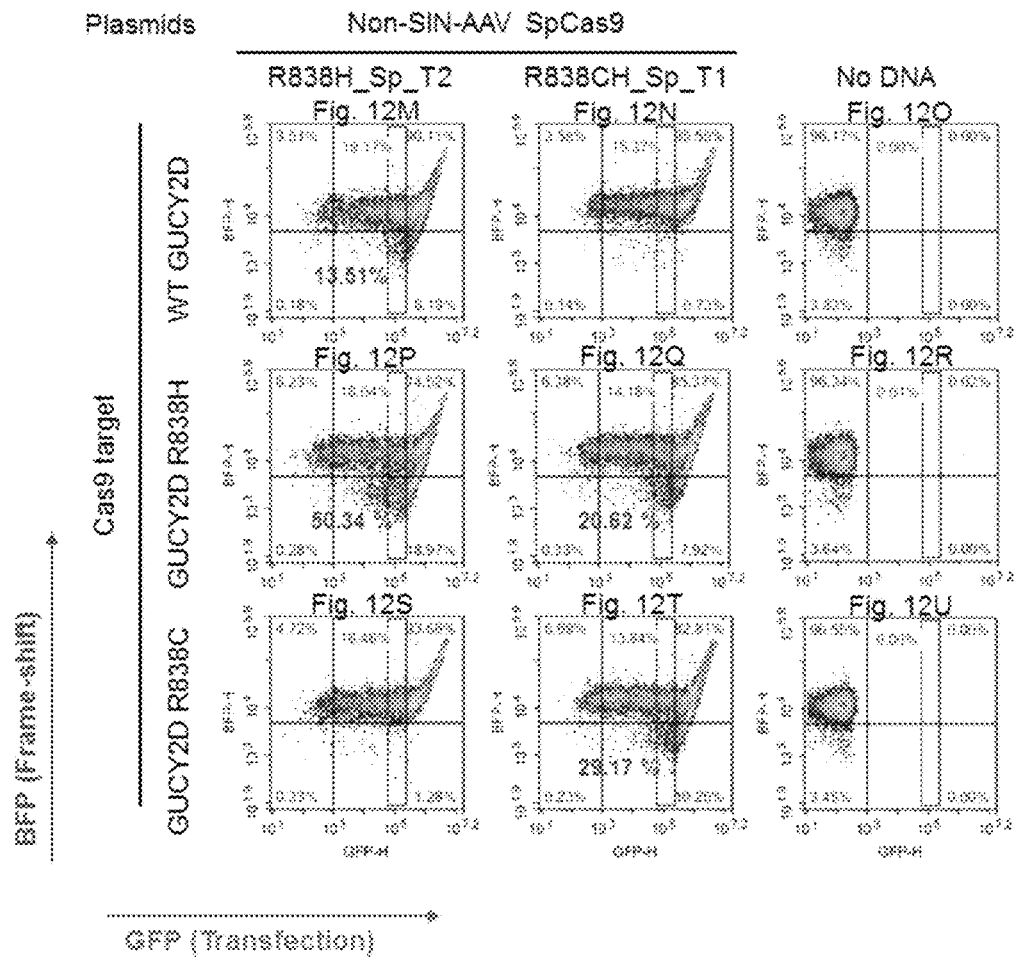

| Guide Name | SEQ ID NO: | | R838 Target site | | SEQ ID NO: |
|---|---|---|---|---|---|
| R838H_Sp_T2 | 5285 | edits → | GGATCTGATCCGGGAGCACA (located in 5' SIN site) <br> TGTGCTCCCGGATCAGATCC (located in 3' SIN site) | | 5327 <br> 5369 |
| R838CH_Sp_T1 | 5398 | edits → | TCTGATCCGGGAGTACACGG (located in 5' SIN site) <br> CCGTGTACTCCCGGATCAGA (located in 3' SIN site) | | 5326 <br> 5368 |

| Guide Name | SEQ ID NO: | | R838 Target site | | SEQ ID NO: |
|---|---|---|---|---|---|
| R838H_Sp_T2 | 5285 | edits → | GGATCTGATCCGGGAGCACA (located in 5' SIN site) | | 5327 |
| | | | TGTGCTCCCGGATCAGATCC (located in 3' SIN site) | | 5369 |
| R838CH_Sp_T1 | 5398 | edits → | TCTGATCCGGGAGTACACGG (located in 5' SIN site) | | 5326 |
| | | | CCGTGTACTCCCGGATCAGA (located in 3' SIN site) | | 5368 |

| Guide Name | SEQ ID NO: | | R838 Target site | | SEQ ID NO: |
|---|---|---|---|---|---|
| R838H_Sp_T2 | 5285 | edits → | GGATCTGATCCGGGAGCACA (located in 5' SIN site)<br>TGTGCTCCCGGATCAGATCC (located in 3' SIN site) | | 5327<br>5369 |
| R838CH_Sp_T1 | 5398 | edits → | TCTGATCCGGGAGTACACGG (located in 5' SIN site)<br>CCGTGTACTCCCGGATCAGA (located in 3' SIN site) | | 5326<br>5368 |

| Guide Name | SEQ ID NO: | | R838 Target site | SEQ ID NO: |
|---|---|---|---|---|
| R838H_Sp_T2 | 5285 | edits → | GGATCTGATCCGGGAGCACA (located in 5' SIN site) | 5327 |
| | | | TGTGCTCCCGGATCAGATCC (located in 3' SIN site) | 5369 |

| Guide Name | SEQ ID NO: | | R838 Target site | | SEQ ID NO: |
|---|---|---|---|---|---|
| R838CH_Sp_T1 | 5398 | edits → | TCTGATCCGGGAGTACACGG<br>CCGTGTACTCCCGGATCAGA | (located in 5' SIN site)<br>(located in 3' SIN site) | 5326<br>5368 |

MATERIALS AND METHODS FOR TREATMENT OF AUTOSOMAL DOMINANT CONE-ROD DYSTROPHY

RELATED APPLICATIONS

This application is a continuation of International Application No. PCT/IB2018/060138, filed Dec. 14, 2018, which claims the benefit of U.S. Provisional Application No. 62/598,682 filed Dec. 14, 2017; U.S. Provisional Application No. 62/670,378 filed May 11, 2018; U.S. Provisional Application No. 62/675,306 filed May 23, 2018; and U.S. Provisional Application No. 62/693,100 filed Jul. 2, 2018. The entire contents of these applications are incorporated herein by reference in their entirety.

FIELD

The present application provides materials and methods for treating autosomal dominant Cone-Rod Dystrophy (CORD).

INCORPORATION BY REFERENCE OF SEQUENCE LISTING

The instant application contains a Sequence Listing which has been submitted electronically in ASCII format via EFS-Web, and is hereby incorporated by reference in its entirety. Said ASCII copy, created on Jun. 12, 2020, is named Sequence_Listing_CBTN_002PCCN.txt and is 10212804 bytes in size.

BACKGROUND

Cone-rod dystrophies (CORD) are genetic ocular disorders characterized by the loss of cone cells, the photoreceptors responsible for both central and color vision. CORD can cause a variety of symptoms including decreased central visual acuity and photophobia, which is a reduced ability to see colors and an increased sensitivity to light, both of which can be early symptoms. Later symptoms can include night blindness and further decrease of visual acuity. Mutations associated with CORD have been identified, including mutations in the GUCY2D gene.

Currently, there are no adequate treatments or therapies to prevent the development of CORD or to restore vision, and there remains a critical need for developing safe and effective treatments for CORD.

SUMMARY

The present disclosure presents a novel method to ameliorate, if not eliminate, an autosomal dominant CORD. The novel approach targets a mutation in the GUCY2D gene, such as an R838H, R838C, or R838S mutation, with a method resulting in the reduction or elimination of expression of the defective protein encoded by a gene containing the mutation. Furthermore, in some cases, the treatment can be effected with a small number of treatments and, in some cases, with a single treatment. The resulting therapy can ameliorate autosomal dominant CORD associated with a mutant GUCY2D gene or, in some cases, can eliminate autosomal dominant CORD associated with a mutant GUCY2D gene.

Provided herein is a method for editing a GUCY2D gene in a human cell. The method comprises introducing into the human cell one or more DNA endonucleases to effect one or more SSBs or DSBs within or near the GUCY2D gene or other DNA sequences that encode regulatory elements of the GUCY2D gene that results in a deletion, insertion, or correction thereby creating an edited human cell.

Also provided herein is a method for editing a R838H, R838C, or R838S mutation in a GUCY2D gene in a human cell. The method comprises: introducing into the human cell one or more DNA endonucleases to effect one or more SSBs or DSBs within or near the R838H, R838C, or R838S mutation in a GUCY2D gene that results in a deletion, insertion, or correction thereby creating an edited human cell.

Also provided herein is a method for editing a GUCY2D gene in a human cell. The method comprises introducing into the human cell one or more deoxyribonucleic acid (DNA) endonucleases to effect one or more single-strand breaks (SSBs) or double-strand breaks (DSBs) within or near the GUCY2D gene or other DNA sequences that encode regulatory elements of the GUCY2D gene that results in a modulation of expression or function of the GUCY2D gene thereby creating an edited human cell.

Also provided herein is a method for editing a R838H, R838C, or R838S mutation in a GUCY2D gene in a human cell. The method comprises: introducing into the human cell one or more DNA endonucleases to effect one or more SSBs or DSBs within or near the R838H, R838C, or R838S mutation in a GUCY2D gene that results in a modulation of expression or function of the GUCY2D gene thereby creating an edited human cell.

Also provided herein is an in vivo method for treating a patient with autosomal dominant CORD. The method comprises: editing a R838H, R838C, or R838S mutation in a GUCY2D gene in a cell of the patient.

Also provided herein is one or more gRNAs for editing a R838H, R838C, or R838S mutation in a GUCY2D gene in a cell from a patient with autosomal dominant CORD. The one or more gRNAs comprises a spacer sequence selected from the group consisting of nucleic acid sequences in SEQ ID NOs: 5282-5313, 5398-5409, and 5434-5443 of the Sequence Listing.

Also provided herein is a gRNA for editing a R838H or R838C mutation in a GUCY2D gene in a cell from a patient with autosomal dominant CORD. The gRNA comprises a spacer sequence selected from the group consisting of nucleic acid sequences in 5398-5409 of the Sequence Listing.

Also provided herein is a gRNA for editing a R838H or R838S mutation in a GUCY2D gene in a cell from a patient with autosomal dominant CORD. The gRNA comprises a spacer sequence selected from the group consisting of nucleic acid sequences in 5434-5443 of the Sequence Listing.

Also provided herein is a therapeutic for treating a patient with autosomal dominant Cone-Rod Dystrophy, the therapeutic comprising at least one or more gRNAs for editing a R838H, R838C, or R838S mutation in a GUCY2D gene. The one or more gRNAs comprises a spacer sequence selected from the group consisting of nucleic acid sequences in SEQ ID NOs: 5282-5313, 5398-5409, and 5434-5443 of the Sequence Listing.

Also provided herein is a therapeutic for treating a patient with autosomal dominant Cone-Rod Dystrophy, the therapeutic comprising a gRNA for editing a R838H or R838C mutation in a GUCY2D gene. The gRNA comprises a spacer sequence selected from the group consisting of nucleic acid sequences in 5398-5409 of the Sequence Listing.

Also provided herein is a therapeutic for treating a patient with autosomal dominant Cone-Rod Dystrophy, the therapeutic comprising a gRNA for editing a R838H or R838S mutation in a GUCY2D gene. The gRNA comprises a spacer sequence selected from the group consisting of nucleic acid sequences in 5434-5443 of the Sequence Listing.

Also provided herein is a therapeutic for treating a patient with autosomal dominant CORD, the therapeutic formed by a method comprising: introducing one or more DNA endonucleases; introducing one or more gRNA or one or more sgRNA for editing a R838H, R838C, or R838S mutation in a GUCY2D gene; and optionally introducing one or more donor template. The one or more gRNAs or sgRNAs comprises a spacer sequence selected from the group consisting of nucleic acid sequences in SEQ ID NOs: 5282-5313, 5398-5409, and 5434-5443 of the Sequence Listing.

Also provided herein is a therapeutic for treating a patient with autosomal dominant CORD, the therapeutic formed by a method comprising: introducing one or more DNA endonucleases; introducing a gRNA or sgRNA for editing a R838H or R838C mutation in a GUCY2D gene; and optionally introducing one or more donor template. The gRNA or sgRNA comprises a spacer sequence selected from the group consisting of nucleic acid sequences in SEQ ID NOs: 5398-5409 of the Sequence Listing.

Also provided herein is a therapeutic for treating a patient with autosomal dominant CORD, the therapeutic formed by a method comprising: introducing one or more DNA endonucleases; introducing a gRNA or sgRNA for editing a R838H or R838S mutation in a GUCY2D gene; and optionally introducing one or more donor template. The gRNA or sgRNA comprises a spacer sequence selected from the group consisting of nucleic acid sequences in SEQ ID NOs: 5434-5443 of the Sequence Listing.

Also provided herein is a kit for treating a patient with autosomal dominant CORD in vivo. The kit comprises one or more gRNAs or sgRNAs for editing a R838H, R838C, or R838S mutation in a GUCY2D gene, one or more DNA endonucleases; and optionally, one or more donor template. The one or more gRNAs or sgRNAs comprises a spacer sequence selected from the group consisting of nucleic acid sequences in SEQ ID NOs: 5282-5313, 5398-5409, and 5434-5443 of the Sequence Listing.

Also provided herein is a kit for treating a patient with autosomal dominant CORD in vivo. The kit comprises a gRNA or sgRNA for editing a R838H or R838C mutation in a GUCY2D gene, one or more DNA endonucleases; and optionally, one or more donor template. The gRNA or sgRNA comprises a spacer sequence selected from the group consisting of nucleic acid sequences in SEQ ID NOs: 5398-5409 of the Sequence Listing.

Also provided herein is a kit for treating a patient with autosomal dominant CORD in vivo. The kit comprises a gRNA or sgRNA for editing a R838H or R838S mutation in a GUCY2D gene, one or more DNA endonucleases; and optionally, one or more donor template. The gRNA or sgRNA comprises a spacer sequence selected from the group consisting of nucleic acid sequences in SEQ ID NOs: 5434-5443 of the Sequence Listing.

Also provided herein is a single-molecule guide RNA (sgRNA) comprising the nucleic acid sequence of SEQ ID NO: 5285.

Also provided herein is a single-molecule guide RNA (sgRNA) comprising the nucleic acid sequence of SEQ ID NO: 5398.

Also provided herein is a single-molecule guide RNA (sgRNA) comprising the nucleic acid sequence of SEQ ID NO: 5286.

Also provided herein is a single-molecule guide RNA (sgRNA) comprising the nucleic acid sequence of SEQ ID NO: 5464.

Also provided herein is a single-molecule guide RNA (sgRNA) comprising the nucleic acid sequence of SEQ ID NO: 5465.

Also provided herein is a single-molecule guide RNA (sgRNA) comprising the nucleic acid sequence of SEQ ID NO: 5466.

Also provided herein is a method for editing an R838H mutation within a GUCY2D gene, the method comprising administering a gRNA or sgRNA comprising SEQ ID NO: 5285.

Also provided herein is a method for editing an R838H mutation within a GUCY2D gene, the method comprising administering a gRNA or sgRNA comprising SEQ ID NO: 5286.

Also provided herein is a method for editing an R838H mutation or R838C mutation within a GUCY2D gene, the method comprising administering a gRNA or sgRNA comprising SEQ ID NO: 5398.

Also provided herein is a method for editing an R838H mutation within a GUCY2D gene, the method comprising administering a gRNA or sgRNA comprising SEQ ID NO: 5464.

Also provided herein is a method for editing an R838H mutation within a GUCY2D gene, the method comprising administering a gRNA or sgRNA comprising SEQ ID NO: 5465.

Also provided herein is a method for editing an R838H mutation or R838C mutation within a GUCY2D gene, the method comprising administering a gRNA or sgRNA comprising SEQ ID NO: 5466.

Also provided herein is a method for treating a patient with an R838H mutation within a GUCY2D gene, the method comprising administering a gRNA or sgRNA comprising SEQ ID NO: 5285 to the patient.

Also provided herein is a method for treating a patient with an R838H mutation within a GUCY2D gene, the method comprising administering a gRNA or sgRNA comprising SEQ ID NO: 5286 to the patient.

Also provided herein is a method for treating a patient with an R838H mutation or R838C mutation within a GUCY2D gene, the method comprising administering a gRNA or sgRNA comprising SEQ ID NO: 5398 to the patient.

Also provided herein is a method for treating a patient with an R838H mutation within a GUCY2D gene, the method comprising administering a gRNA or sgRNA comprising SEQ ID NO: 5464 to the patient.

Also provided herein is a method for treating a patient with an R838H mutation within a GUCY2D gene, the method comprising administering a gRNA or sgRNA comprising SEQ ID NO: 5465 to the patient.

Also provided herein is a method for treating a patient with an R838H mutation or R838C mutation within a GUCY2D gene, the method comprising administering a gRNA or sgRNA comprising SEQ ID NO: 5466 to the patient.

Also provided herein is a self-inactivating CRISPR-Cas system. The self-inactivating CRISPR-Cas system comprises a first segment, a second segment, and one or more third segments. The first segment comprises a nucleotide sequence that encodes a polypeptide inducing site-directed mutagenesis. The second segment comprises a nucleotide sequence that encodes a guide RNA (gRNA) or a single-molecule guide RNA (sgRNA) wherein the gRNA or sgRNA comprise SEQ ID NO: 5285 or 5464. The one or more third segments comprise a self-inactivating (SIN) site. The gRNA or sgRNA is substantially complementary to the SIN site. The gRNA or sgRNA is substantially complementary to a genomic target sequence.

Also provided herein is a self-inactivating CRISPR-Cas system. The self-inactivating CRISPR-Cas system comprises a first segment, a second segment, and one or more third segments. The first segment comprises a nucleotide sequence that encodes a polypeptide inducing site-directed mutagenesis. The second segment comprises a nucleotide sequence that encodes a guide RNA (gRNA) or a single-molecule guide RNA (sgRNA) wherein the gRNA or sgRNA comprise SEQ ID NO: 5398 or 5466. The one or more third segments comprise a self-inactivating (SIN) site. The gRNA or sgRNA is substantially complementary to the SIN site. The gRNA or sgRNA is substantially complementary to a genomic target sequence.

Also provided herein is a self-inactivating CRISPR-Cas system. The self-inactivating CRISPR-Cas system comprises a first segment, a second segment, and one or more third segments. The first segment comprises a nucleotide sequence that encodes a SpCas9 or any variants thereof. The second segment comprises a nucleotide sequence that encodes a gRNA or sgRNA. The one or more third segments comprise a self-inactivating (SIN) site. The gRNA or sgRNA is substantially complementary to the SIN site. The gRNA or sgRNA is substantially complementary to a genomic target sequence. The SIN site comprises a sequence selected from the group consisting of SEQ ID NOs: 5478-5492

It is understood that the inventions described in this specification are not limited to the examples summarized in this Summary. Various other aspects are described and exemplified herein.

BRIEF DESCRIPTION OF THE DRAWINGS

Various aspects of materials and methods for treatment of automosomal dominant CORD disclosed and described in this specification can be better understood by reference to the accompanying figures, in which:

FIG. 1A depicts the type II CRISPR/Cas system including gRNA.

FIG. 1B depicts the type II CRISPR/Cas system including sgRNA.

FIGS. 2A-C show the sgRNA sequence, the target DNA sequence, and the reverse strand of the target DNA sequence to which the sgRNA binds, for each of 42 sgRNA sequences.

FIG. 2A shows the sgRNA sequence, for each of 42 sgRNA sequences.

FIG. 2B shows the target DNA sequence, for each of 42 sgRNA sequences.

FIG. 2C shows the reverse strand of the target DNA sequence to which the sgRNA binds, for each of 42 sgRNA sequences.

FIGS. 2D-F show the sgRNA sequence, the target DNA sequence, and the reverse strand of the target DNA sequence to which the sgRNA binds, for each of 22 sgRNA sequences.

FIG. 2D shows the sgRNA sequence, for each of 22 sgRNA sequences.

FIG. 2E shows the target DNA sequence, for each of 22 sgRNA sequences.

FIG. 2F shows the reverse strand of the target DNA sequence to which the sgRNA binds, for each of 22 sgRNA sequences.

FIGS. 3A-F are maps depicting the target DNA sequences for gRNAs targeting the wild-type GUCY2D gene or gRNAs targeting the R838H, R838C, or R838S mutation within the GUCY2D gene.

FIG. 3A is a map depicting the target DNA sequences for gRNAs that target the wild-type GUCY2D gene (nucleotides 12,077-12,138 of SEQ ID NO: 5266 shown, and complementary strand).

FIG. 3B is a map depicting the target DNA sequences for gRNAs that target the R838H mutation within the GUCY2D gene (nucleotides 12,077-12,138 of SEQ ID NO: 5266 with a G→A mutation at nucleotide 12,108, and complementary strand).

FIG. 3C is a map depicting the target DNA sequences for gRNAs that target the R838C mutation within the GUCY2D gene (nucleotides 12,077-12,138 of SEQ ID NO: 5266 with a G→T mutation at nucleotide 12,108, and complementary strand).

FIG. 3D is a map depicting the target DNA sequences for gRNAs that target the R838S mutation within the GUCY2D gene (nucleotides 12,077-12,138 of SEQ ID NO: 5266 with a G→A mutation at nucleotide 12,108, and complementary strand).

FIG. 3E is a map depicting the target DNA sequences for gRNAs that target both the R838H mutation and R838C mutation within the GUCY2D gene (nucleotides 12,077-12,138 of SEQ ID NO: 5266 with a G→T mutation at nucleotide 12,108 and a C→A mutation at nucleotide 12,109, and complementary strand).

FIG. 3F is a map depicting the target DNA sequences for gRNAs that target both the R838H mutation and R838S mutation within the GUCY2D gene (nucleotides 12,077-12,138 of SEQ ID NO: 5266 with a G→A mutation at nucleotide 12,108 and a C→A mutation at nucleotide 12,109, and complementary strand).

FIG. 4A describes the on-target editing efficiency of sgRNAs targeting the wild-type GUCY2D gene (sgRNAs comprising SEQ ID NO: 5274 or 5278) and the off-target editing efficiency of sgRNAs targeting the R838H, R838C, or R838S mutation within the GUCY2D gene (sgRNAs comprising SEQ ID NO: 5284, 5289, 5296, 5300, 5304, 5308, 5398, or 5403).

FIG. 4B describes the on-target editing efficiency of sgRNAs targeting the wild-type GUCY2D gene (sgRNAs comprising SEQ ID NO: 5275 or 5279) and the off-target editing efficiency of sgRNAs targeting the R838H, R838C, or R838S mutation within the GUCY2D gene (sgRNAs comprising SEQ ID NO: 5285, 5290, 5297, 5301, 5305, 5309, 5399, or 5404).

FIG. 4C describes the on-target editing efficiency of gRNAs targeting the wild-type GUCY2D gene (sgRNAs comprising SEQ ID NO: 5276 or 5280) and the off-target editing efficiency of sgRNAs targeting the R838H, R838C, or R838S mutation within the GUCY2D gene (sgRNAs comprising SEQ ID NO: 5286, 5291, 5298, 5302, 5306, 5310, 5400, or 5405).

FIG. 4D describes the on-target editing efficiency of sgRNAs targeting the wild-type GUCY2D gene (sgRNAs comprising SEQ ID NO: 5277 or 5281) and the off-target editing efficiency of sgRNAs targeting the R838H, R838C, or R838S mutation within the GUCY2D gene (sgRNAs comprising SEQ ID NO: 5287, 5292, 5299, 5303, 5307, 5311, 5402, or 5407).

FIG. 4E describes the off-target editing efficiency of sgRNAs targeting the R838H or R838C mutation within the GUCY2D gene (sgRNAs comprising SEQ ID NO: 5288, 5293, 5401, or 5406).

FIG. 6A describes the on-target and off-target editing efficiency of a plasmid transcribed sgRNA targeting the wild-type GUCY2D gene (a sgRNA comprising SEQ ID NO: 5274) at 48 hours post transfection and the on-target and off-target editing efficiency of plasmid transcribed sgRNAs targeting the R838H or R838C mutation within the GUCY2D gene (sgRNAs comprising SEQ ID NO: 5285, 5286, 5398, 5399, or 5402) at 48 hours post transfection.

FIG. 6B describes the on-target and off-target editing efficiency of a plasmid transcribed sgRNA targeting the wild-type GUCY2D gene (a sgRNA comprising SEQ ID NO: 5274) at 72 hours post transfection and the on-target and off-target editing efficiency of plasmid transcribed sgRNAs targeting the R838H or R838C mutation within the GUCY2D gene of a plasmid (sgRNAs comprising SEQ ID NO: 5285, 5286, 5398, 5399, or 5402) at 72 hours post transfection.

FIGS. 7A-J show a donor plasmid used to prepare 3 different HEK 293FT reporter cell lines and flow cytometry data for the 3 different HEK 293FT reporter cell lines that are co-transfected with a plasmid encoding SpCas9 driven by human EF1α core promoter and a plasmid containing R838H_Sp_T2 sgRNA (sgRNA comprising SEQ ID NO: 5285), or R838CH_Sp_T1 sgRNA (sgRNA comprising SEQ ID NO: 5398) under U6 promoter, or no sgRNA.

FIG. 7A depicts a donor plasmid comprising a Cas9 target site (either a wild-type GUCY2D gene, a GUCY2D gene comprising a R838H mutation, or a GUCY2D gene comprising a R838C mutation) fused to a blue flurescence protein.

FIG. 7B shows flow cytometry data for HEK 293FT reporter cells that have the wild-type GUCY2D gene as the Cas9 target site and that are co-transfected with a plasmid encoding SpCas9 driven by human elongation factor 1 alpha (EF1α) core promoter and a plasmid containing R838H_Sp_T2 sgRNA (sgRNA comprising SEQ ID NO: 5285) under U6 promoter.

FIG. 7C shows flow cytometry data for HEK 293FT reporter cells that have the wild-type GUCY2D gene as the Cas9 target site and that are co-transfected with a plasmid encoding SpCas9 driven by human EF1α core promoter and a plasmid containing R838CH_Sp_T1 sgRNA (sgRNA comprising SEQ ID NO: 5398) under U6 promoter.

FIG. 7D shows flow cytometry data for HEK 293FT reporter cells that have the wild-type GUCY2D gene as the Cas9 target site and that are not transfected with any sgRNA.

FIG. 7E shows flow cytometry data for HEK 293FT reporter cells that have the R838H mutation as the Cas9 target site and that are co-transfected with a plasmid encoding SpCas9 driven by human EF1α core promoter and a plasmid containing R838H_Sp_T2 sgRNA (sgRNA comprising SEQ ID NO: 5285) under U6 promoter.

FIG. 7F shows flow cytometry data for HEK 293FT reporter cells that have the R838H mutation as the Cas9 target site and that are co-transfected with a plasmid encoding SpCas9 driven by human EF1α core promoter and a plasmid containing R838CH_Sp_T1 sgRNA (sgRNA comprising SEQ ID NO: 5398) under U6 promoter.

FIG. 7G shows flow cytometry data for HEK 293FT reporter cells that have the R838H mutation as the Cas9 target site and that are not transfected with any sgRNA.

FIG. 7H shows flow cytometry data for HEK 293FT reporter cells that have the R838C mutation as the Cas9 target site and that are co-transfected with a plasmid encoding SpCas9 driven by human EF1α core promoter and a plasmid containing R838H_Sp_T2 sgRNA (sgRNA comprising SEQ ID NO: 5285) under U6 promoter.

FIG. 7I shows flow cytometry data for HEK 293FT reporter cells that have the R838C mutation as the Cas9 target site and that are co-transfected with a plasmid encoding SpCas9 driven by human EF1α core promoter and a plasmid containing R838CH_Sp_T1 sgRNA (sgRNA comprising SEQ ID NO: 5398) under U6 promoter.

FIG. 7J shows flow cytometry data for HEK 293FT reporter cells that have the R838C mutation as the Cas9 target site and that are not transfected with any sgRNA.

FIGS. 8A-B are graphs showing the percent reduction of cGMP and absolute cGMP for HEK293T-SpCas9 cells co-transfected with a vector containing R838H cDNA and IVT sgRNAs that target the R838H mutation within the GUCY2D gene.

FIG. 8A is a graph showing the percent reduction of cGMP for HEK293T-SpCas9 cells co-transfected with a vector containing R838H cDNA and IVT sgRNAs that target the R838H mutation within the GUCY2D gene (sgRNAs comprising SEQ ID NO: 5284, 5285, 5286, 5287, 5288, 5289, 5290, 5291, 5292, or 5293).

FIG. 8B is a graph showing the absolute cGMP for HEK293T-SpCas9 cells co-transfected with a vector containing R838H cDNA and IVT sgRNAs that target the R838H mutation within the GUCY2D gene (sgRNAs comprising SEQ ID NO: 5284, 5285, 5286, 5287, 5288, 5289, 5290, 5291, 5292, or 5293).

FIG. 9A is a graph showing the percent reduction of cGMP for HEK293T-SpCas9 cells co-transfected with a vector containing R838H cDNA and IVT sgRNAs that target the R838H mutation within the GUCY2D gene (sgRNAs comprising SEQ ID NO: 5285, 5286, or 5291).

FIG. 9B is a graph showing the absolute cGMP for HEK293T-SpCas9 cells co-transfected with a vector containing R838H cDNA and IVT sgRNAs that target the R838H mutation within the GUCY2D gene (sgRNAs comprising SEQ ID NO: 5285, 5286, or 5291).

FIG. 10A is a graph showing the percent reduction of cGMP for HEK293T-SpCas9 cells co-transfected with a vector containing R838H cDNA and pAAV-U6-R838 sgRNA that targets the R838H mutation within the GUCY2D gene (pAAV-5285 or pAAV-5286).

FIG. 10B is a graph showing the absolute cGMP for HEK293T-SpCas9 cells co-transfected with a vector containing R838H cDNA and pAAV-U6-R838 sgRNA that targets the R838H mutation within the GUCY2D gene (pAAV-5285 or pAAV-5286).

FIG. 11A depicts the structural arrangement of SIN-AAV SpCas9 version 1 (sEF1α promoter).

FIG. 11B depicts the structural arrangement of SIN-AAV SpCas9 version 2 (sEF1α promoter).

FIG. 11C depicts the structural arrangement of Non-SIN-AAV SpCas9 (sEF1α promoter).

FIG. 11D depicts the structural arrangement of an AAV sequence of pSIA012 and pSIA015. pSIA012 is a plasmid comprising an AAV sequence that encodes a sgRNA comprising SEQ ID NO: 5285. pSIA015 is a plasmid comprising an AAV sequence that encodes a sgRNA comprising SEQ ID NO: 5398.

FIGS. 12A-U show flow cytometry data for 3 different HEK 293FT reporter cell lines that are co-transfected with pSIA012, a plasmid comprising an AAV sequence that encodes R838H_Sp_T2 sgRNA (a sgRNA comprising SEQ ID NO: 5285) or pSIA015, a plasmid comprising an AAV sequence that encodes R838CH_Sp_T1 sgRNA (a sgRNA comprising SEQ ID NO: 5398), and either (1) a SIN-AAV SpCas9 version 1 (sEF1α promoter), (2) a SIN-AAV SpCas9 version 2 (sEF1α promoter), or (3) a Non-SIN-AAV SpCas9 (sEF1α promoter).

FIG. 12A shows flow cytometry data for HEK 293FT reporter cells that have the wild-type GUCY2D gene as the Cas9 target site and that are co-transfected with (1) pSIA012 and (2) a SIN-AAV SpCas9 version 1 (sEF1α).

FIG. 12B shows flow cytometry data for HEK 293FT reporter cells that have the wild-type GUCY2D gene as the Cas9 target site and that are co-transfected with (1) pSIA015 and (2) a SIN-AAV SpCas9 version 1 (sEF1α).

FIG. 12C shows flow cytometry data for HEK 293FT reporter cells that have the R838H mutation as the Cas9 target site and that are co-transfected with (1) pSIA012 and (2) a SIN-AAV SpCas9 version 1 (sEF1α).

FIG. 12D shows flow cytometry data for HEK 293FT reporter cells that have the R838H mutation as the Cas9 target site and that are co-transfected with (1) pSIA015 and (2) a SIN-AAV SpCas9 version 1 (sEF1α).

FIG. 12E shows flow cytometry data for HEK 293FT reporter cells that have the R838C mutation as the Cas9 target site and that are co-transfected with (1) pSIA012 and (2) a SIN-AAV SpCas9 version 1 (sEF1α).

FIG. 12F shows flow cytometry data for HEK 293FT reporter cells that have the R838C mutation as the Cas9 target site and that are co-transfected with (1) pSIA015 and (2) a SIN-AAV SpCas9 version 1 (sEF1α).

FIG. 12G shows flow cytometry data for HEK 293FT reporter cells that have the wild-type GUCY2D gene as the Cas9 target site and that are co-transfected with (1) pSIA012 and (2) a SIN-AAV SpCas9 version 2 (sEF1α).

FIG. 12H shows flow cytometry data for HEK 293FT reporter cells that have the wild-type GUCY2D gene as the Cas9 target site and that are co-transfected with a (1) pSIA015 and a (2) SIN-AAV SpCas9 version 2 (sEF1α).

FIG. 12I shows flow cytometry data for HEK 293FT reporter cells that have the R838H mutation as the Cas9 target site and that are co-transfected with (1) pSIA012 and (2) a SIN-AAV SpCas9 version 2 (sEF1α).

FIG. 12J shows flow cytometry data for HEK 293FT reporter cells that have the R838H mutation as the Cas9 target site and that are co-transfected with (1) pSIA015 and (2) a SIN-AAV SpCas9 version 2 (sEF1α).

FIG. 12K shows flow cytometry data for HEK 293FT reporter cells that have the R838C mutation as the Cas9 target site and that are co-transfected with (1) pSIA012 and (2) a SIN-AAV SpCas9 version 2 (sEF1α).

FIG. 12L shows flow cytometry data for HEK 293FT reporter cells that have the R838C mutation as the Cas9 target site and that are co-transfected with (1) pSIA015 and (2) a SIN-AAV SpCas9 version 2 (sEF1α).

FIG. 12M shows flow cytometry data for HEK 293FT reporter cells that have the wild-type GUCY2D gene as the Cas9 target site and that are co-transfected with (1) pSIA012 and (2) a Non-SIN-AAV SpCas9 (sEF1α).

FIG. 12N shows flow cytometry data for HEK 293FT reporter cells that have the wild-type GUCY2D gene as the Cas9 target site and that are co-transfected with (1) pSIA015 and (2) a Non-SIN-AAV SpCas9 (sEF1α).

FIG. 12O shows flow cytometry data for HEK 293FT reporter cells that have the wild-type GUCY2D gene as the Cas9 target site and that are not transfected with any DNA.

FIG. 12P shows flow cytometry data for HEK 293FT reporter cells that have the R838H mutation as the Cas9 target site and that are co-transfected with (1) pSIA012 and (2) a Non-SIN-AAV SpCas9 (sEF1α).

FIG. 12Q shows flow cytometry data for HEK 293FT reporter cells that have the R838H mutation as the Cas9 target site and that are co-transfected with (1) pSIA015 and (2) a Non-SIN-AAV SpCas9 (sEF1α).

FIG. 12R shows flow cytometry data for HEK 293FT reporter cells that have the R838H mutation as the Cas9 target site and that are not transfected with any DNA.

FIG. 12S shows flow cytometry data for HEK 293FT reporter cells that have the R838C mutation as the Cas9 target site and that are co-transfected with (1) pSIA012 and (2) a Non-SIN-AAV SpCas9 (sEF1α).

FIG. 12T shows flow cytometry data for HEK 293FT reporter cells that have the R838C mutation as the Cas9 target site and that are co-transfected with (1) pSIA015 and (2) Non-SIN-AAV SpCas9 (sEF1α).

FIG. 12U shows flow cytometry data for HEK 293FT reporter cells that have the R838C mutation as the Cas9 target site and that are not transfected with any sgRNA.

FIG. 13A is a western blot showing SpCas9, Actin, and GFP expression in HEK 293FT reporter cells that have the wild-type GUCY2D gene as the Cas9 target site. These HEK 293FT reporter cells are transfected with either pSIA012 or pSIA015. The HEK 293FT reporter cells are also transfected with either (1) a SIN-AAV SpCas9 version 1 (sEF1α promoter), (2) a SIN-AAV SpCas9 version 2 (sEF1α promoter), or (3) a Non-SIN-AAV SpCas9 (sEF1α promoter).

FIG. 13B is a western blot showing SpCas9, Actin, and GFP expression in HEK 293FT reporter cells that have the R838H mutation as the Cas9 target site. These HEK 293 FT reporter cells are transfected with either pSIA012 or pSIA015. The HEK 293FT reporter cells are also transfected with either (1) a SIN-AAV SpCas9 version 1 (sEF1α promoter), (2) a SIN-AAV SpCas9 version 2 (sEF1α promoter), or (3) a Non-SIN-AAV SpCas9 (sEF1α promoter).

FIG. 13C is a western blot showing SpCas9, Actin, and GFP expression in HEK 293FT reporter cells that have the R838C mutation as the Cas9 target site. These HEK 293 FT reporter cells are transfected with either pSIA012 or pSIA015. The HEK 293FT reporter cells are also transfected with either (1) a SIN-AAV SpCas9 version 1 (sEF1α promoter), (2) a SIN-AAV SpCas9 version 2 (sEF1α promoter), or (3) a Non-SIN-AAV SpCas9 (sEF1α promoter).

FIG. 14A depicts the structural arrangement of SIN-AAV SpCas9 version 1 (GRK1 promoter).

FIG. 14B depicts the structural arrangement of SIN-AAV SpCas9 version 2 (GRK1 promoter).

FIG. 14C depicts the structural arrangement of Non-SIN-AAV SpCas9 (GRK1 promoter).

FIG. 15A is a western blot showing SpCas9, Beta-Tubulin, and GFP expression in cells isolated from mouse retinas that were previously injected with an AAV vector that encodes R838H_Sp_T2 sgRNA (a sgRNA comprising SEQ ID NO: 5285); AAV-R838H (SEQ ID NO: 5481); and either (1) a SIN-AAV SpCas9 version 1 (GRK1), (2) a SIN-AAV SpCas9 version 2 (GRK1), or (3) a Non-SIN-AAV SpCas9 (GRK1).

FIG. 15B is a western blot showing SpCas9, Beta-Tubulin, and GFP expression in cells isolated from mouse retinas that were previously injected with an AAV vector that encodes R838CH_Sp_T1 sgRNA (a sgRNA comprising SEQ ID NO: 5398); AAV-R838H (SEQ ID NO: 5481); and either (1) a SIN-AAV SpCas9 version 1 (GRK1), (2) a SIN-AAV SpCas9 version 2 (GRK1), or (3) a Non-SIN-AAV SpCas9 (GRK1).

BRIEF DESCRIPTION OF THE SEQUENCE LISTING

Figure 1A:
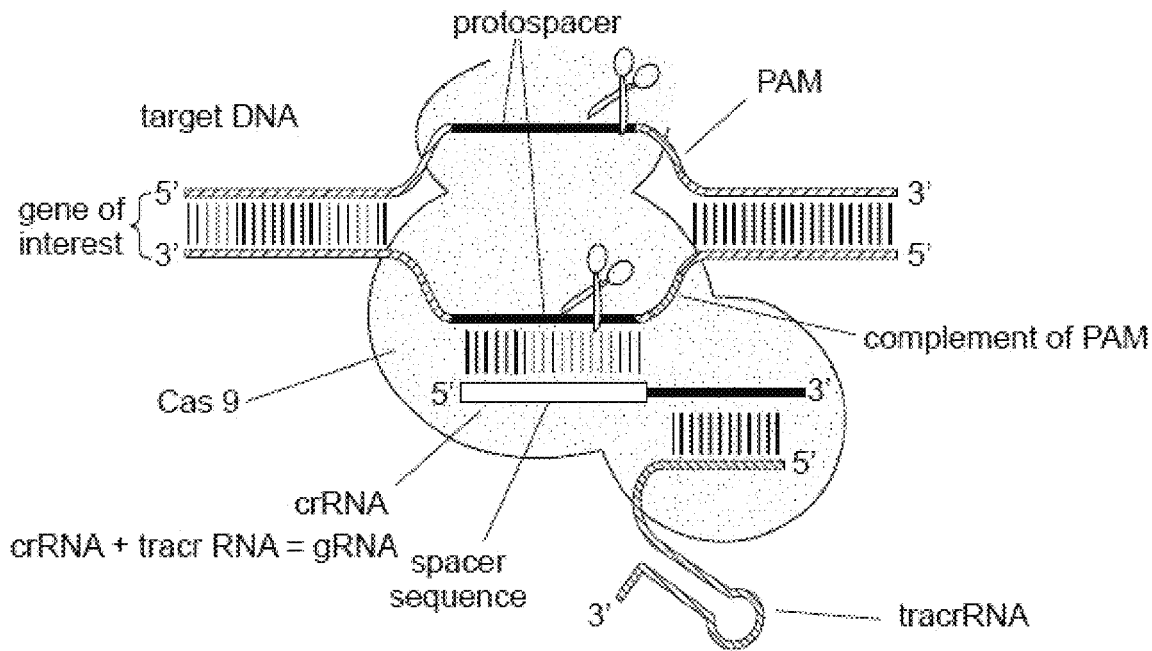
FIGS. 1A-B depict the type II CRISPR/Cas system.

SEQ ID NOs: 1-612 are Cas endonuclease ortholog sequences.

SEQ ID NOs: 613-4696 are miRNA sequences.

SEQ ID NOs: 4697-5265 are AAV serotype sequences.

SEQ ID NO: 5266 is a GUCY2D nucleotide sequence.

SEQ ID NOs: 5267-5269 show sample sgRNA backbone sequences that SpCas9 is complexed with.

SEQ ID NO: 5270 is a sample gRNA for a *Streptococcus pyogenes* Cas9 endonuclease.

SEQ ID NO: 5271 shows a known family of homing endonuclease, as classified by its structure.

SEQ ID NOs: 5272-5281 are 19-20 bp spacer sequences for targeting within or near a GUCY2D gene or other DNA sequence that encodes a regulatory element of the GUCY2D gene with a *S. pyogenes* Cas9 endonuclease or *S. aureus* Cas9 endonuclease.

SEQ ID NOs: 5282-5293 are 19-20 bp spacer sequences for targeting within or near a R838H mutation in a GUCY2D gene with a *S. pyogenes* Cas9 endonuclease or *S. aureus* Cas9 endonuclease.

SEQ ID NOs: 5294-5303 are 19-20 bp spacer sequences for targeting within or near a R838C mutation in a GUCY2D gene with a *S. pyogenes* Cas9 endonuclease or *S. aureus* Cas9 endonuclease.

SEQ ID NOs: 5304-5313 are 19-20 bp spacer sequences for targeting within or near a R838S mutation in a GUCY2D gene with a *S. pyogenes* Cas9 endonuclease or *S. aureus* Cas9 endonuclease.

SEQ ID NOs: 5314-5355 are sequences that represent the target DNA sequences, for each of 42 sgRNA sequences in FIG. 2A.

SEQ ID NOs: 5356-5397 are sequences that represent the reverse strands of the target DNA sequence to which the sgRNA will bind, for each of 42 sgRNA sequences in FIG. 2A.

SEQ ID NOs: 5398-5409 are 19-20 bp spacer sequences for targeting within or near a R838H mutation or R838C mutation in a GUCY2D gene with a *S. pyogenes* Cas9 endonuclease or *Staphylococcus aureus* Cas9 endonuclease.

SEQ ID NOs: 5410-5421 are sequences that represent the target DNA sequences, for each of 12 sgRNA sequences in FIG. 2D.

SEQ ID NOs: 5422-5433 are sequences that represent the reverse strands of the target DNA sequence to which the sgRNA will bind, for each of 12 sgRNA sequences in FIG. 2D.

SEQ ID NOs: 5434-5443 are 19-20 bp spacer sequences for targeting within or near a R838H mutation or R838S mutation in a GUCY2D gene with a *S. pyogenes* Cas9 endonuclease or *S. aureus* Cas9 endonuclease.

SEQ ID NOs: 5444-5453 are sequences that represent the target DNA sequences, for each of 10 sgRNA sequences in FIG. 2D.

SEQ ID NOs: 5454-5463 are sequences that represent the reverse strands of the target DNA sequence to which the sgRNA will bind, for each of 10 sgRNA sequences in FIG. 2D.

SEQ ID NO: 5464 is a full-length sgRNA comprising SEQ ID NOs: 5285 and 5267.

SEQ ID NO: 5465 is a full-length sgRNA comprising SEQ ID NOs: 5286 and 5267.

SEQ ID NO: 5466 is a full-length sgRNA comprising SEQ ID NOs: 5398 and 5267.

SEQ ID NO: 5467 does not include a sequence.

SEQ ID NO: 5468 is a plasmid comprising an AAV sequence that encodes for a sgRNA comprising SEQ ID NOs: 5274 and 5267.

SEQ ID NO: 5469 is pSIA012, a plasmid comprising an AAV sequence that encodes for a sgRNA comprising SEQ ID NO: 5464.

SEQ ID NO: 5470 is a plasmid comprising an AAV sequence that encodes for a sgRNA comprising SEQ ID NO: 5465.

SEQ ID NO: 5471 is pSIA015, a plasmid comprising an AAV sequence that encodes for a sgRNA comprising SEQ ID NO: 5466.

Figure 14A:
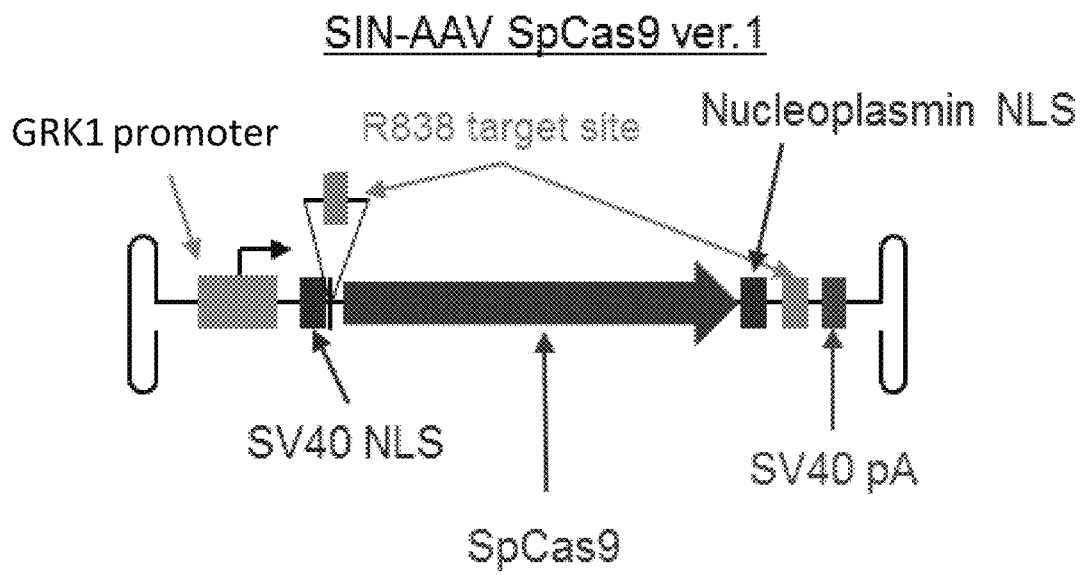
FIGS. 14A-C depict the structural arrangement of SIN-AAV SpCas9 version 1 (GRK1 promoter), SIN-AAV SpCas9 version 2 (GRK1 promoter), and Non-SIN-AAV SpCas9 (GRK1 promoter).

SEQ ID NO: 5472 is a plasmid sequence comprising SIN-AAV SpCas9 ver. 1 (GRK1 promoter), depicted in FIG. 14A.

Figure 14B:
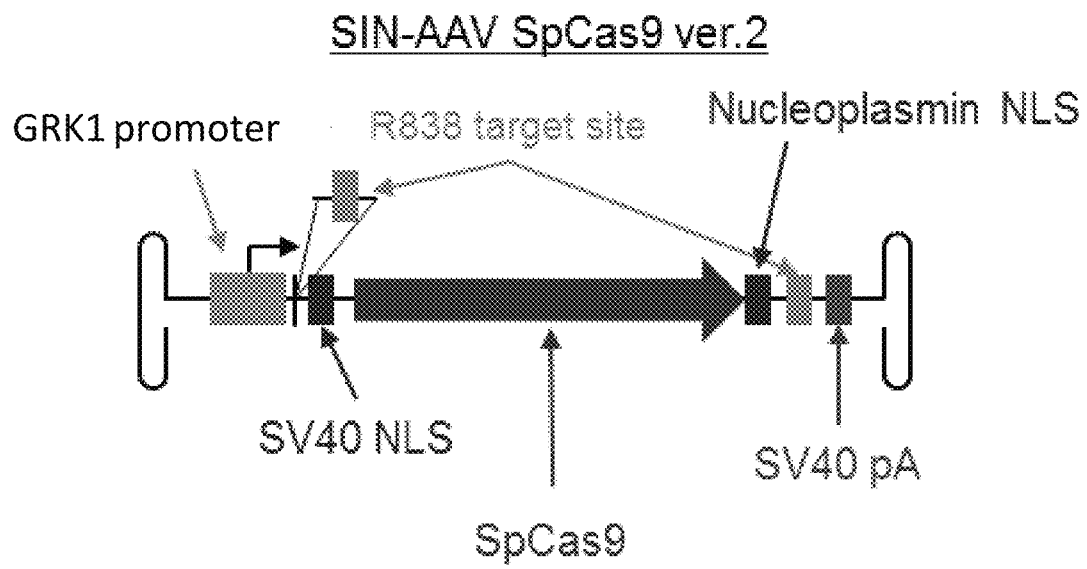

SEQ ID NO: 5473 is a plasmid sequence comprising SIN-AAV SpCas9 ver. 2 (GRK1 promoter), depicted in FIG. 14B.

Figure 14C:
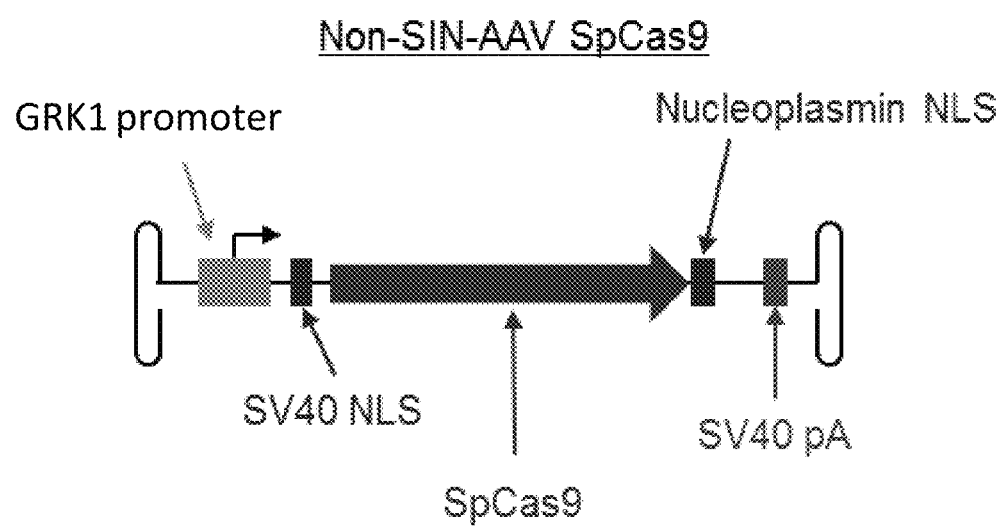

SEQ ID NO: 5474 is a plasmid sequence comprising Non-SIN-AAV SpCas9 (GRK1 promoter), depicted in FIG. 14C.

Figure 11A:
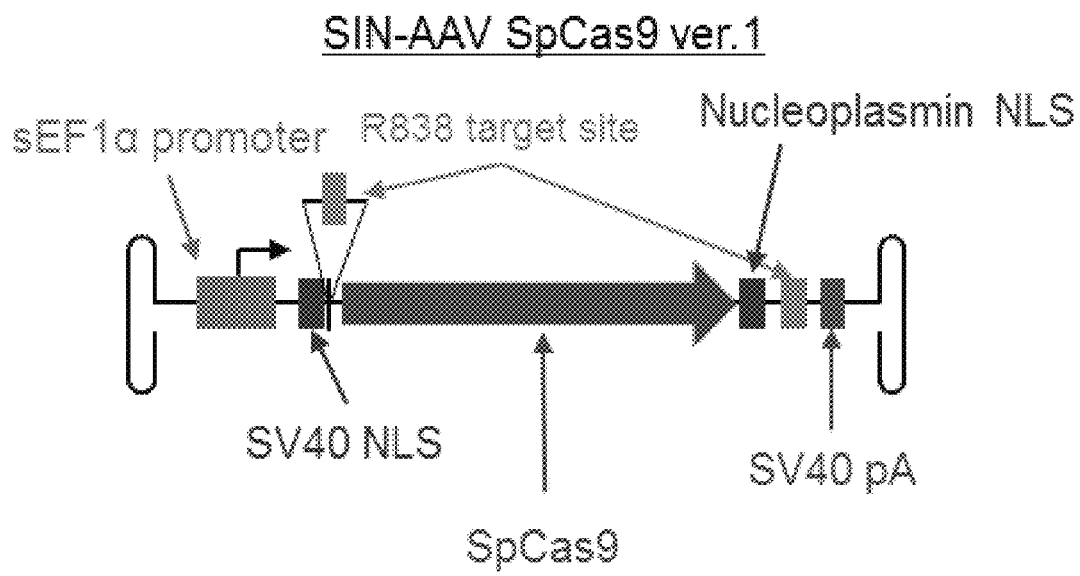
FIGS. 11A-D depict the structural arrangement of SIN-AAV SpCas9 version 1 (sEF1α promoter), SIN-AAV SpCas9 version 2 (sEF1α promoter), Non-SIN-AAV SpCas9 (sEF1α promoter), and the AAV sequence of pSIA012 and pSIA015.

SEQ ID NO: 5475 is a plasmid sequence comprising SIN-AAV SpCas9 ver. 1 (sEF1α promoter), depicted in FIG. 11A.

Figure 11B:
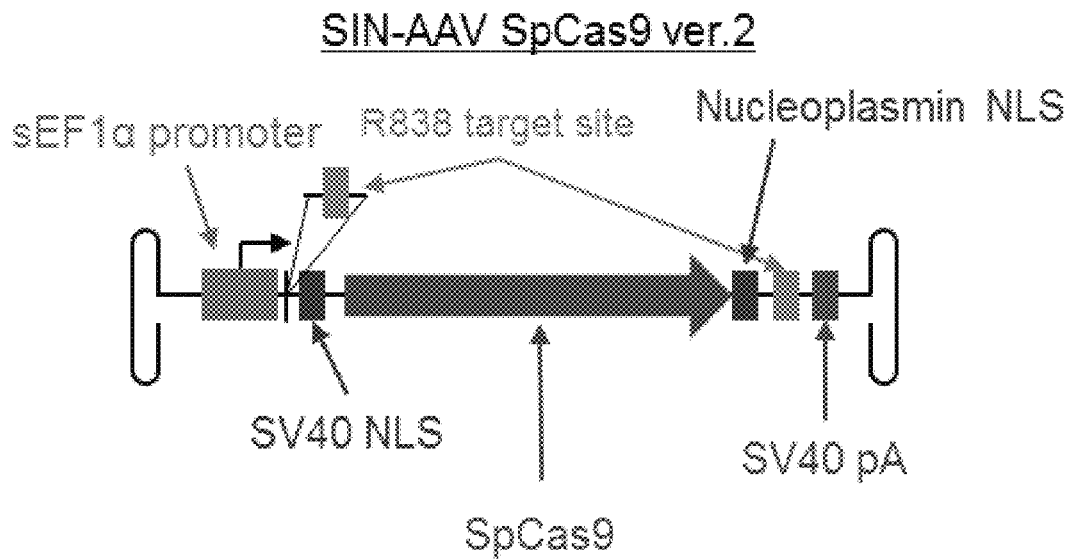

SEQ ID NO: 5476 is a plasmid sequence comprising SIN-AAV SpCas9 ver. 2 (sEF1α promoter), depicted in FIG. 11B.

Figure 11C:
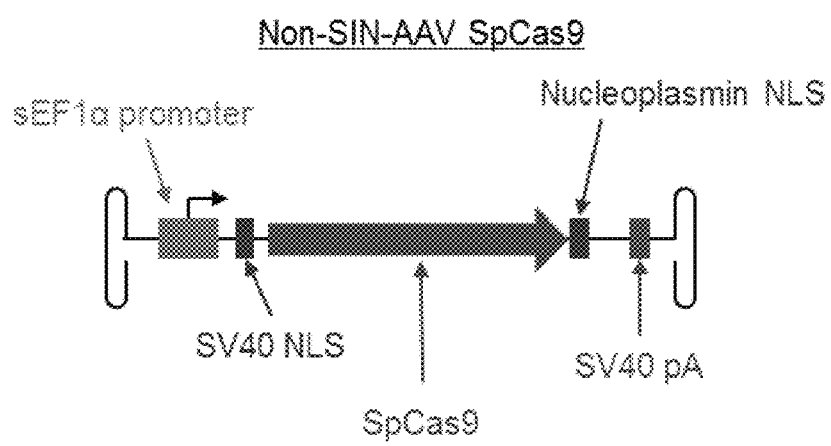

SEQ ID NO: 5477 is a plasmid sequence comprising Non-SIN-AAV SpCas9 (sEF1α promoter), depicted in FIG. 11C.

SEQ ID NO: 5478 is a possible SIN site located upstream of the SpCas9 ORF in the SIN-AAV SpCas9 ver.1, depicted in FIGS. 11A and 14A.

SEQ ID NO: 5479 is a possible SIN site located upstream of the SpCas9 ORF in the SIN-AAV SpCas9 ver. 2, depicted in FIGS. 11B and 14B.

SEQ ID NO: 5480 is a possible SIN site located downstream of the SpCas9 ORF in
SIN-AAV SpCas9 ver. 1 depicted in FIGS. 11A and 14A and downstream of the SpCas9 ORF in SIN-AAV SpCas9 ver. 2 depicted in FIGS. 11B and 14B.

SEQ ID NO: 5481 is a possible SIN site located upstream of the SpCas9 ORF in the SIN-AAV SpCas9 ver.1, depicted in FIGS. 11A and 14A.

SEQ ID NO: 5482 is a possible SIN site located upstream of the SpCas9 ORF in the SIN-AAV SpCas9 ver. 2, depicted in FIGS. 11B and 14B.

SEQ ID NO: 5483 is a possible SIN site located downstream of the SpCas9 ORF in SIN-AAV SpCas9 ver. 1 depicted in FIGS. 11A and 14A and downstream of the SpCas9 ORF in SIN-AAV SpCas9 ver. 2 depicted in FIGS. 11B and 14B.

SEQ ID NO: 5484 is a possible SIN site located upstream of the SpCas9 ORF in the SIN-AAV SpCas9 ver.1, depicted in FIGS. 11A and 14A.

SEQ ID NO: 5485 is a possible SIN site located upstream of the SpCas9 ORF in the SIN-AAV SpCas9 ver. 2, depicted in FIGS. 11B and 14B.

SEQ ID NO: 5486 is a possible SIN site located downstream of the SpCas9 ORF in SIN-AAV SpCas9 ver. 1 depicted in FIGS. 11A and 14A and downstream of the SpCas9 ORF in SIN-AAV SpCas9 ver. 2 depicted in FIGS. 11B and 14B.

SEQ ID NO: 5487 is a possible SIN site located upstream of the SpCas9 ORF in the SIN-AAV SpCas9 ver.1, depicted in FIGS. 11A and 14A.

SEQ ID NO: 5488 is a possible SIN site located upstream of the SpCas9 ORF in the SIN-AAV SpCas9 ver. 2, depicted in FIGS. 11B and 14B.

SEQ ID NO: 5489 is a possible SIN site located downstream of the SpCas9 ORF in SIN-AAV SpCas9 ver. 1 depicted in FIGS. 11A and 14A and downstream of the SpCas9 ORF in SIN-AAV SpCas9 ver. 2 depicted in FIGS. 11B and 14B.

SEQ ID NO: 5490 is a possible SIN site located upstream of the SpCas9 ORF in the SIN-AAV SpCas9 ver.1, depicted in FIGS. 11A and 14A.

SEQ ID NO: 5491 is a possible SIN site located upstream of the SpCas9 ORF in the SIN-AAV SpCas9 ver. 2, depicted in FIGS. 11B and 14B.

SEQ ID NO: 5492 is a possible SIN site located downstream of the SpCas9 ORF in SIN-AAV SpCas9 ver. 1 depicted in FIGS. 11A and 14A and downstream of the SpCas9 ORF in SIN-AAV SpCas9 ver. 2 depicted in FIGS. 11B and 14B.

SEQ ID NO: 5493 is the sequence for AAV-R838H.

SEQ ID NOs: 5494-5505 show sample sgRNA backbone sequences that SaCas9 is complexed with.

SEQ ID NO: 5506 is the AAV sequence in pSIA012.

SEQ ID NO: 5507 is the AAV sequence in pSIA015.

SEQ ID NO: 5508 is the AAV sequence in SIN-AAV-SpCas9 version 1 (GRK1).

SEQ ID NO: 5509 is the AAV sequence in SIN-AAV-SpCas9 version 2 (GRK1).

SEQ ID NO: 5510 is the AAV sequence in SIN-AAV-SpCas9 version 1 (sEF1α).

SEQ ID NO: 5511 is the AAV sequence in SIN-AAV-SpCas9 version 2 (sEF1α).

SEQ ID NO: 5512 is a plasmid sequence for pSpCas9 (BB)-2A-miRFP670 ("pSpCas9").

SEQ ID NO: 5513 is a spacer sequence for a gRNA or sgRNA encoded by pSIA003 from Examples 32-34.

SEQ ID NO: 5514 is pSIA022, a plasmid comprising an AAV sequence that encodes for a sgRNA comprising SEQ ID NO: 5274.

DETAILED DESCRIPTION

Applicants have discovered a novel method for treating an autosomal dominant CORD, e.g., a CORD associated with a mutation in a GUCY2D gene. The method can result in slowing the development of CORD or preventing development of disease in an individual. Applicants have also discovered a self-inactivating CRISPR/Cas system.

Therapeutic Approach

The methods provided herein, regardless of whether a cellular, ex vivo or in vivo method can involve one or a combination of the following methods. One method involves reducing or eliminating expression of a GUCY2D allele containing a mutation (e.g., an R838H, R838C, or R838S mutation) at the protein level using non-homologous end joining (NHEJ) to introduce a frameshift mutation in the R838H, R838C, or R838S mutant allele. The frameshift can be caused by an insertion or deletion that arises during NHEJ. In another method, a mutant allele (e.g., an R838H, R838C, or R838S mutation) is corrected by HDR. A third method includes knocking-in GUCY2D cDNA into a GUCY2D gene locus or into a safe harbor locus.

The NHEJ frameshifting strategy can involve inducing one single stranded break or double stranded break within or near the R838H, R838C, or R838S mutation in the GUCY2D gene with one or more CRISPR endonucleases and a gRNA (e.g., crRNA+tracrRNA, or sgRNA), or two or more single stranded breaks or double stranded breaks within or near the R838H, R838C, or R838S mutation in the GUCY2D gene with two or more CRISPR endonucleases and two or more sgRNAs. This approach can prevent the transcription/synthesis of the R838H, R838C, or R838S mutatant allele by causing a frameshift in the R838H, R838C, or R838S mutant allele. This method utilizes gRNAs or sgRNAs specific for the R838H, R838C, or R838S mutation in the GUCY2D gene.

The HDR correction strategy can involve inducing one single stranded break or double stranded break within or near the R838H, R838C, or R838S mutation in the GUCY2D gene with one or more CRISPR endonucleases and a gRNA (e.g., crRNA+tracrRNA, or sgRNA), or two or more single stranded breaks or double stranded breaks within or near the R838H, R838C, or R838S mutation in the GUCY2D gene with one or more CRISPR endonucleases (Cas9, Cpf1 and the like) and two or more gRNAs, in the presence of a donor DNA template introduced exogenously to direct the cellular DSB response to Homology-Directed Repair. The donor DNA template can be a short single stranded oligonucleotide, a short double stranded oligonucleotide, a long single or double stranded DNA molecule. The methods can provide gRNA pairs that make a deletion by cutting the gene twice, one gRNA cutting at the 5' end of the R838H, R838C, or R838S mutation and the other gRNA cutting at the 3' end of the R838H, R838C, or R838S mutation that facilitates insertion of a new sequence from a polynucleotide donor template to replace the R838H, R838C, or R838S mutation in the GUCY2D gene. The cutting can be accomplished by a pair of DNA endonucleases that each makes a DSB (one DSB on each end of the R838H, R838C, or R838S mutation), or by multiple nickases that together make a DSB (one DSB on each end of the R838H, R838C, or R838S mutation). This method utilizes gRNAs or sgRNAs specific for the R838H, R838C, or R838S mutation in the GUCY2D gene and donor DNA molecules.

The knock-in strategy involves knocking-in GUCY2D cDNA into the GUCY2D gene locus using a gRNA (e.g., crRNA+tracrRNA, or sgRNA) or a pair of gRNAs targeting upstream of or in the first or other exon and/or intron of the GUCY2D gene, or in a safe harbor site (such as AAVS1). The donor DNA can be single or double stranded DNA.

The advantages for the above strategies (frameshift, correction, and knock-in) are similar, including in principle both short and long term beneficial clinical and laboratory effects. The knock-in approach provides at least one advantage over the frameshift and correction approach—the ability to treat all patients versus only a subset of patients.

Such methods use endonucleases, such as CRISPR-associated (Cas9, Cpf1 and the like) nucleases, to stably correct the R838H, R838C, or R838S mutation within the genomic locus of the GUCY2D gene. Any CRISPR endonuclease can be used in the methods of the present disclosure, each CRISPR endonuclease having its own associated PAM, which can or cannot be disease specific. For example, gRNA spacer sequences for targeting the R838H, R838C, or R838S mutation in the GUCY2D gene with a CRISPR/Cas9 endonuclease from *S. pyogenes* or *S. aureus* have been identified in SEQ ID NOs. 5282-5313, 5398-5409, and 5434-5443 of the Sequence Listing.

Examples set forth in the present disclosure can induce single stranded breaks or double stranded breaks within or near the R838H, R838C, or R838S mutation in the GUCY2D gene to introduce a frameshift or correct the R838H, R838C, or R838S mutation within the GUCY2D gene with as few as a single treatment (rather than deliver potential therapies for the lifetime of the patient).

Cone-Rod Dystrophy (CORD)

Cone rod dystrophies (CORD) are a group of inherited retinal dystrophies characterized by retinal pigment deposits predominantly localized in the macular region. CORD leads to primary degeneration of cones followed by loss of rods and has a prevalence of 1:40,000 (Garcia-Hoyos et al., 2011, Molecular Vision; Mukherjee et al., 2014, Eye, 28:481-487). Some forms of CORD have been observed to be inherited as an autosomal dominant, autosomal recessive or X-linked recessive trait while others occur spontaneously. Onset of the disease normally occurs in the first two decades of life. There are four major causative genes involved in CORD: ABCA4 (causing 30-60% of all autosomal recessive CORDs), CRX and GUCY2D (responsible for 35% of autosomal dominant CORDs/cone dystrophies), and RPGR (causing X-linked CORDs). All GUCY2D gene mutations in patients with autosomal dominant CORD are located at codon 838 or the two adjacent codons 837 and 839, leading to degeneration of photoreceptors and visual deterioration (Mukherjee et al., 2014, Eye, 28:481-487; Kitiratschky et al., 2008, Science, 49: 5015-5023). Mutations in the GUCY2D gene account for 20% of all CORD disease. Mutations in codon 838 account for up to 95% of all mutations in the GUCY2D gene leading to photoreceptor degeneration due to the mutated RetCG-1 protein. In the US itself there are 1,500 patients with codon 838 mutations in the GUCY2D gene (Garcia-Hoyos et al., 2011, Molecular Vision 17: 1103-1109; Mukherjee et al., 2014, Eye, 28:481-487; Kitiratschky et al., 2008, Science, 49: 5015-5023), with 19 new patients per year (Hamel et al., 2006, Orphanet Journal of Rare Diseases 2: 1-7).

A hallmark of CORDs is retinal pigment deposits visible on fundus examination, predominantly localized in the macular region (Hamel et al., 2006, Orphanet Journal of Rare Diseases 2: 1-7). Most CORD patients display the following symptoms: decreased central vision, color vision defects, photophobia and decreased sensitivity in the central field at early stages, followed by progressive loss in peripheral vision and night blindness at later stages. The clinical course of CORDs is generally more severe and rapid than of rod cone dystrophies, leading to earlier legal blindness and disability (Hamel et al., 2006, Orphanet Journal of Rare Diseases 2: 1-7; Mukherjee et al., 2014, Eye, 28:481-487). Non syndromic CORDs are genetically heterogenous and may be inherited as autosomal dominant, autosomal recessive, or X-linked trait (Mukherjee et al., 2014, Eye, 28:481-487).

CORD can cause a variety of symptoms that include decreased central visual acuity and photophobia which is a reduced ability to see colors and an increased sensitivity to light, both of which are the first symptoms to appear in the first decasde of life, followed by night blindness and further decrease of visual acuity. CORD can be divided into two groups, stationary CORD in which symptoms remain stable and are mostly present at birth or early childhood, and progressive CORD in which symptoms slowly become worse over time, so that a person is considered legally blind with a visual acuity that is 20/200 or worse. Progression of CORD is generally more severe and rapid than rod cone dystrophy (e.g. retinitis pigmentosa), leading to earlier blindness. Total blindness is not common in individuals affected with cone dystrophy and peripheral vision is usually unaffected. Affected individuals can see well at night or under conditions of low light as the rod cells are usually unaffected. Key endpoints to assess treatment related outcomes include measuring visual acuity, electroretinography response, optical coherence tomography and patient reported outcome.

CORD caused by a R838H, R838C, or R838S mutation in a GUCY2D gene is a monogenic disorder with autosomal dominant inheritance. If a patient only has one R838H, R838C, or R838S mutant allele, a frameshift can be introduced into one R838H, R838C, or R838S mutant allele per cell to prevent the transcription/synthesis of the one R838H, R838C, or R838S mutant allele. A novel approach has been discovered for ameliorating the effects of autosomal dominant CORD by introducing a frameshift into one R838H, R838C, or R838S mutant allele per cell to prevent the transcription/synthesis of the one R838H, R838C, or R838S mutant allele.

Also, if a patient only has one R838H, R838C, or R838S mutant allele, the one R838H, R838C, or R838S mutant allele can be corrected to restore RetGC1 function. If a patient has two R838H, R838C, or R838S mutant alleles, both R838H, R838C, or R838S mutant alleles can be corrected with HDR to restore RetGC1 function.

Introducing a frameshift into a R838H, R838C, or R838S mutant allele or correcting a R838H, R838C, or R838S mutant allele using gene editing provides an important improvement over existing or potential therapies, such as introduction of RetGC1 expression cassettes through lentivirus delivery and integration because of its preciseness and lower adverse effects.

Guanylate Cyclase 2D (GUCY2D) Gene

The GUCY2D gene spans a sequence of approximately 17.7 kb, ranges from 8,002,594-8,020,339 bp, and encodes for the protein retinal membrane guanylate cyclase-1 (RetGC1) that functions in the maintenance of normal vision and is located within the photoreceptors (expressed in both rod and cone photoreceptors) in the retina. The protein is predominantly expressed in cone outer segments and has a molecular weight of 120 Kd. The GUCY2D cDNA consists of 3641 nucleotides, spanning 17.7 kb of genomic DNA. RetGC-1 takes part in the recovery phase of phototransduction and is located in the marginal region of the cone's outer segments. RetGC proteins play an important role in restoring photoreceptor sensitivity due to their involvement in the synthesis of cGMP, and regulate the calcium level in cells. Once light enters the eye, it stimulates specialized pigments in photoreceptor cells which further trigger a series of chemical reactions that produce an electrical signal. This electrical signal is decoded by the brain as vision. Following stimulation, the photoreceptors return to their resting state and await the next round of stimulation. RetGC-1 protein takes part in a chemical reaction that helps return photoreceptors to their resting state after light exposure (Boye, 2016, Advances in Experimental Medicine and Biology). Light stimulates the degradation of cGMP, causing the closing of cation channels, which results in cell hyperpolarization and neurotransmitter release. At lower concentration, calcium stimulates RetGCs and as a consequence the cGMP level is restored. As a result, the cation channels reopen and photosensitivity is restored to the cell (Garcia-Hoyos et al., 2011, Molecular Vision 17: 1103-1109).

So far, several identified GUCY2D mutations in CORD patients are located at the codon 838 or the two adjacent ones 837, and 839 (Mukherjee et al., 2014, Eye, 28:481-487; Garcia-Hoyos et al., 2011, Molecular Vision 17: 1103-1109). R838X mutations and adjacent mutations induce a gain of function of RetGC-1 leading to higher calcium concentration and inducing photoreceptor degeneration (Garcia-Hoyos et al., 2011, Molecular Vision 17: 1103-1109; Mukherjee et al., 2014, Eye, 28:481-487; Hamel et al., 2007, Orphanet Journal of Rare Diseases). Until now, several identified GUCY2D mutations in CORD patients are located at codon 838 or the two adjacent codons 837 and 839 (Mukherjee et al., 2014, Eye, 28:481-487; Garcia-Hoyos et al., 2011, Molecular Vision 17: 1103-1109) leading to degeneration of photoreceptors and visual deterioration. These mutations produce a gain of function in increasing the affinity of the RetGC-1 for the guanylate cyclase activating proteins even in high calcium concentration, leading to a higher cGMP concentration (Mukherjee et al., 2014, Eye, 28:481-487; Garcia-Hoyos et al., 2011, Molecular Vision 17: 1103-1109; Weigell-Weber et al., 2000, Archives of Ophthalmology; Van Ghelue et al., 2000, Ophthalmic Genetics; Wilkie et al., 2000, Human Molecular Genetics). The photoreceptor death is believed to be caused by the high cGMP concentration keeping cGMP-gated cation channel open, resulting in an increased calcium concentration in the cell (Mukherjee et al., 2014, Eye, 28:481-487; Tucker et al., 1999, Proceedings of the National Academy of Sciences, 96:9039-9044).

GUCY2D can also be referred to as GUC1A4; RCD2; LCA1; GUC2D; retGC; LCA; ROSGC; CYGD; RETGC-1; CORD6; ROS-GC1; RETGC; CORDS; RETGC1; Guanylate Cyclase 2D, Membrane (Retina-Specific); Rod Outer Segment Membrane Guanylate Cyclase; Guanylate Cyclase 2D, Retinal; Retinal Guanylate Cyclase 1; Cone Rod Dystrophy 6; EC 4.6.1.2; RETGC-1; GUC1A4; ROS-GC; RetGC; CORD6; GUC2D; EC 4.6.1; ROS-GC1; RETGC1; CORDS; ROSGC; CYGD; LCA1; RCD2; LCA. GUCY2D has a cytogenetic location of 17p13.1 and the genomic coordinates as seen on Ensembl database are on Chromosome 17 on the forward strand at position 8,002,594-8,020,339. A nucleotide sequence of GUCY2D is shown as SEQ ID NO: 5266. RP11-1099M24.8 is the gene upstream of GUCY2D on the forward strand and ALOX15B is the gene downstream of GUCY2D on the reverse strand. Contained within the GUCY2D gene is the gene RP11-474L23.3 on the reverse strand. The gene RP11-1099M24.9 is located on the reverse strand opposite of GUCY2D. GUCY2D has a NCBI gene ID of 3000, Uniprot ID of Q02846 and Ensembl Gene ID of ENSG00000132518. GUCY2D has 1,684 SNPs, 19 introns and 20 exons. The exon identifier from Ensembl and the start/stop sites of the introns and exons are shown in Table 1.

TABLE 1

Exons and Introns for GUCY2D

| Exon No. | Exon ID | Start/Stop | Intron No. | Intron based on Exon ID | Start/Stop |
|---|---|---|---|---|---|
| EX1 | ENSE00001365187 | 8,002,594-8,002,734 | INT1 | Intron ENSE00001365187-ENSE00001300811 | 8,002,735-8,003,038 |
| EX2 | ENSE00000905467 | 8,003,852-8,004,156 | INT2 | Intron ENSE00001300811-ENSE00000905467 | 8,003,769-8,003,851 |
| EX3 | ENSE00000905480 | 8,015,743-8,015,841 | INT3 | Intron ENSE00000905467-ENSE00001308194 | 8,004,157-8,006,362 |
| EX4 | ENSE00001293688 | 8,007,931-8,008,032 | INT4 | Intron ENSE00001308194-ENSE00001330137 | 8,006,715-8,007,059 |
| EX5 | ENSE00001293922 | 8,014,859-8,015,051 | INT5 | Intron ENSE00001330137-ENSE00001305434 | 8,007,145-8,007,425 |
| EX6 | ENSE00001300099 | 8,012,144-8,012,350 | INT6 | Intron ENSE00001305434-ENSE00001293688 | 8,007,529-8,007,930 |
| EX7 | ENSE00001300811 | 8,003,039-8,003,768 | INT7 | Intron ENSE00001293688-ENSE00001311972 | 8,008,033-8,009,505 |
| EX8 | ENSE00001305434 | 8,007,426-8,007,528 | INT8 | Intron ENSE00001311972-ENSE00001300099 | 8,009,587-8,012,143 |
| EX9 | ENSE00001306526 | 8,013,103-8,013,252 | INT9 | Intron ENSE00001300099-ENSE00001321424 | 8,012,351-8,012,449 |
| EX10 | ENSE00001308194 | 8,006,363-8,006,714 | INT10 | Intron ENSE00001321424-ENSE00001306526 | 8,012,607-8,013,102 |
| EX11 | ENSE00001310706 | 8,015,328-8,015,502 | INT11 | Intron ENSE00001306526-ENSE00001328414 | 8,013,253-8,013,879 |
| EX12 | ENSE00001311387 | 8,014,601-8,014,764 | INT12 | Intron ENSE00001328414-ENSE00001311387 | 8,014,029-8,014,600 |
| EX13 | ENSE00001311972 | 8,009,506-8,009,586 | INT13 | Intron ENSE00001311387-ENSE00001293922 | 8,014,765-8,014,858 |
| EX14 | ENSE00001312940 | 8,016,205-8,016,290 | INT14 | Intron ENSE00001293922-ENSE00001310706 | 8,015,052-8,015,327 |
| EX15 | ENSE00001317612 | 8,016,443-8,016,554 | INT15 | Intron ENSE00001310706-ENSE00000905480 | 8,015,503-8,015,742 |
| EX16 | ENSE00001321424 | 8,012,450-8,012,606 | INT16 | Intron ENSE00000905480-ENSE00001329972 | 8,015,842-8,015,926 |
| EX17 | ENSE00001328414 | 8,013,880-8,014,028 | INT17 | Intron ENSE00001329972-ENSE00001312940 | 8,016,022-8,016,204 |
| EX18 | ENSE00001329972 | 8,015,927-8,016,021 | INT18 | Intron ENSE00001312940-ENSE00001317612 | 8,016,291-8,016,442 |
| EX19 | ENSE00001330137 | 8,007,060-8,007,144 | INT19 | Intron ENSE00001317612-ENSE00001390086 | 8,016,555-8,020,127 |
| EX20 | ENSE00001390086 | 8,020,128-8,020,339 | | | |

Table 2 provides information on all of the transcripts for the GUCY2D gene based on the Ensembl database. Provided in Table 2 are the transcript ID from Ensembl and corresponding NCBI RefSeq ID for the transcript, the translation ID from Ensembl and the corresponding NCBI RefSeq ID for the protein, the biotype of the transcript sequence as classified by Ensembl and the exons and introns in the transcript based on the information in Table 1.

GUCY2D has 1,684 SNPs and the NCBI rs number and/or UniProt VAR number for the SNPs of the GUCY2D gene are rs2534, rs2816, rs3813585, rs3829789, rs3891083, rs3928731, rs4791452, rs4791456, rs4792111, rs7406106, rs7501868, rs7503918, rs8068722, rs8069344, rs8071166, rs9889612, rs9891137, rs9891219, rs9905393, rs9905402, rs9912176, rs9914315, rs9914686, rs9914937, rs11655487, rs11655691, rs12103471, rs12103519, rs12103521,

TABLE 2

Transcript Information for GUCY2D

| Transcript ID | Transcript NCBI RefSeq ID | Translation ID | Protein NCBI RefSeq ID | Sequence Biotype | Exon ID from Table 1 | Intron ID from Table 1 |
|---|---|---|---|---|---|---|
| ENST00000254854.4 | NM_000180 | ENSP00000254854 | NP_000171 | Protein coding | EX1, EX2, EX3, EX4, EX5, EX6, EX7, EX8, EX9, EX10, EX11, EX12, EX13, EX14, EX15, EX16, EX17, EX18, EX19, EX20 | INT1, INT2, INT3, INT4, INT5, INT6, INT7, INT8, INT9, INT10, INT11, INT12, INT13, INT14, INT15, INT16, INT17, INT18, INT19 |
| ENST00000574510.1 | — | — | | Retained intron | EX20, EX21 | INT20 | rs12449814, rs12602083, rs28743021, rs28933695,
rs33914314, rs33942683, rs34016036, rs34049818,
rs34065746, rs34331388, rs34463160, rs34466558,
rs34594470, rs34596269, rs34598902, rs34671919,
rs34922798, rs35134646, rs35146471, rs35357335,
rs35616384, rs35881051, rs35883105, rs55687426,
rs55916957, rs56034424, rs56056557, rs56130505,
rs56280231, rs56316238, rs56348143, rs57184071,
rs57273310, rs58765829, rs60130989, rs61749663,
rs61749664, rs61749665, rs61749667, rs61749668,
rs61749669, rs61749670, rs61749671, rs61749672,
rs61749673, rs61749674, rs61749675, rs61749676,
rs61749677, rs61749678, rs61749679, rs61749680,
rs61749681, rs61749682, rs61749683, rs61749753,
rs61749754, rs61749755, rs61749756, rs61749758,
rs61749759, rs61750160, rs61750161, rs61750162,
rs61750163, rs61750164, rs61750166, rs61750167,
rs61750168, rs61750169, rs61750170, rs61750171,
rs61750172, rs61750173, rs61750174, rs61750175,
rs61750176, rs61750177, rs61750178, rs61750179,
rs61750180, rs61750181, rs61750182, rs61750183,
rs61750184, rs61750185, rs61750186, rs61750187,
rs61750188, rs61750189, rs61750190, rs61750192,
rs61750193, rs61750194, rs61750196, rs61750197,
rs61750198, rs61750199, rs62065069, rs62065070,
rs62641254, rs63340060, rs63749076, rs63749078,
rs67594392, rs72203439, rs72841478, rs72841480,
rs72841481, rs72841482, rs73237655, rs73244190,
rs73978651, rs73978652, rs73978653, rs73978654,
rs73978655, rs73978656, rs73978658, rs73978659,
rs74579703, rs74656480, rs74864625, rs75290069,
rs75837616, rs76196120, rs76459165, rs77430877,
rs77752392, rs77922915, rs78117741, rs78380494,
rs78434534, rs78761797, rs78844078, rs78901930,
rs78908751, rs79288861, rs79347759, rs79581544,
rs79887212, rs79980119, rs80076597, rs80245692,
rs112085163, rs112360110, rs112372281, rs112764660,
rs112923697, rs112984002, rs113031167, rs113153323,
rs113332317, rs115598390, rs116236245, rs116728094,
rs116841812, rs116870332, rs117241209, rs117853745,
rs118026892, rs118057940, rs118102619, rs118140564,
rs137853897, rs138162268, rs138176835, rs138200238,
rs138255027, rs138298187, rs138596240, rs138635198,
rs138836357, rs138869083, rs138922415, rs139019420,
rs139046650, rs139168077, rs139616184, rs139731548,
rs139763939, rs140005435, rs140366544, rs140436048,
rs140628227, rs140638938, rs140657975, rs140661218,
rs140889612, rs140936694, rs140991876, rs141214199,
rs141229863, rs141346556, rs141352623, rs141360883,
rs141592651, rs141837808, rs141917297, rs141956583,
rs141967896, rs142050758, rs142207894, rs142275378,
rs142351773, rs142368822, rs142415521, rs142997995,
rs143323176, rs143524082, rs143535791, rs143585840,
rs143604121, rs143607596, rs143650826, rs143730352,
rs143745703, rs143761257, rs143938678, rs144151076,
rs144291605, rs144349779, rs144442115, rs144458688,
rs144565168, rs144659131, rs145060888, rs145344081,
rs145420245, rs145717676, rs146031822, rs146149224,
rs146406238, rs146570135, rs146820642, rs146849545,
rs146855363, rs146872553, rs147017233, rs147164228,
rs147166962, rs147201985, rs147410617, rs147586061,
rs147656459, rs148136213, rs148394581, rs148448937,
rs148624438, rs148761225, rs148871664, rs148942873,
rs148987106, rs149149530, rs149260011, rs149314785,
rs149560134, rs149722832, rs149866657, rs150173998,
rs150185423, rs150422660, rs150742659, rs150797198,
rs151052136, rs151079263, rs151106252, rs151126238,
rs151268449, rs151330485, rs180740641, rs180796231,
rs180896227, rs181356213, rs181566410, rs181567056,
rs181800610, rs182105834, rs182237936, rs182456792,
rs183308730, rs183331808, rs183393377, rs183480892,
rs183556945, rs183561005, rs184130107, rs184151004,
rs184164679, rs184234997, rs184286345, rs184725910,
rs184811496, rs185088930, rs185157201, rs185513239,
rs185569607, rs185713115, rs185920216, rs186268358,
rs186335397, rs186508466, rs186802043, rs186826861,
rs186938529, rs187098034, rs187499915, rs187668100,
rs187761992, rs187833219, rs187834138, rs187999872,
rs188568530, rs188638994, rs188708948, rs188779114,
rs189065870, rs189141326, rs189183021, rs189559705,
rs189605015, rs189807747, rs189930296, rs189984380,
rs190283426, rs190420345, rs190468215, rs190680904,
rs190700778, rs190851646, rs191165076, rs191204702,
rs191332697, rs191576243, rs191818936, rs191907268,
rs192007830, rs192059023, rs192306625, rs192765108,
rs192836968, rs192859514, rs193175998, rs193212053,
rs199611541, rs199708312, rs199817768, rs199828903,
rs199835050, rs199912675, rs199931193, rs199953653,
rs199966203, rs200032594, rs200128473, rs200189360,
rs200211315, rs200215575, rs200241218, rs200403362,
rs200558780, rs200586401, rs200637525, rs200651999,
rs200700723, rs200705417, rs200855025, rs200886585,
rs201008187, rs201054971, rs201090802, rs201119605,
rs201196538, rs201294458, rs201319533, rs201383207,
rs201388569, rs201414567, rs201541863, rs201587670,
rs201656108, rs201717870, rs201897109, rs202094105,
rs202111469, rs202132636, rs267606857, rs281865408,
rs281865409, rs281865410, rs281865411, rs281865412,
rs281865413, rs367660008, rs367711120, rs367755752,
rs367767119, rs367817490, rs368301973, rs368330301,
rs368349186, rs368384232, rs368480652, rs368557900,
rs368799458, rs368916122, rs368923721, rs368944056,
rs368945604, rs368958527, rs369035095, rs369222553,
rs369247789, rs369315814, rs369527655, rs369547545,
rs369607137, rs369663256, rs369920240, rs370054772,
rs370166526, rs370291650, rs370295773, rs370303747,
rs370306654, rs370318503, rs370350737, rs370607318,
rs370725838, rs370742162, rs370833664, rs370916719,
rs371160436, rs371176908, rs371322812, rs371367958,
rs371458632, rs371533971, rs371541944, rs371565742,
rs371677282, rs371718267, rs371908939, rs371919912,
rs371952237, rs372005126, rs372011559, rs372093845,
rs372118691, rs372151247, rs372189031, rs374354168,
rs374464654, rs375010731, rs375105072, rs375259185,
rs375319109, rs375424336, rs375428889, rs375468242,
rs375574116, rs375686386, rs375727197, rs375760706,
rs375851554, rs376006766, rs376062280, rs376076112,
rs376337508, rs376364350, rs376439753, rs376468724,
rs376479795, rs376508683, rs376601845, rs376615794,
rs376759049, rs376861829, rs376929203, rs376992406,
rs377021127, rs377103968, rs377199837, rs377279983,
rs377287956, rs374969713, rs374927150, rs374924527,
rs374800328, rs374679518, rs374658427, rs374636320,
rs374580575, rs374566845, rs374520619, rs374515716,
rs374507808, rs374507426, rs374505063, rs374138416,
rs374065209, rs374031991, rs373866646, rs373827556,
rs373788984, rs373767265, rs373615436, rs373533477,
rs373468027, rs373400629, rs373362030, rs373357165,
rs373010281, rs372902332, rs372651614, rs372631047,
rs372543612, rs372437131, rs377299382, rs377349549,
rs377388031, rs377557911, rs377568220, rs377594823,
rs377617525, rs377622295, rs377648185, rs377650196,
rs386834239, rs397700887, rs398123233, rs527329237,
rs527542013, rs527646004, rs527659830, rs527767509, rs528169554, rs528203345, rs528258925, rs528791875, rs528826742, rs529037612, rs529180514, rs529232821, rs529348303, rs529594203, rs529615133, rs529702465, rs529726426, rs529993769, rs530057359, rs530185073, rs530209613, rs530328021, rs531023711, rs531091295, rs531217355, rs531378185, rs531556241, rs531612488, rs531669033, rs531693520, rs531982313, rs532142507, rs532153534, rs532339805, rs532388657, rs532466020, rs532577225, rs532826586, rs533083983, rs533311236, rs533407112, rs533940473, rs534022358, rs534195509, rs534270598, rs534452349, rs534482693, rs534505519, rs534591759, rs535329733, rs535365241, rs535373419, rs535800696, rs535966503, rs535982563, rs536011574, rs536530182, rs536731863, rs536792434, rs536803598, rs536805410, rs537127961, rs537485807, rs537729498, rs537757201, rs537797103, rs537928701, rs537953527, rs537992694, rs538000618, rs538161935, rs538470494, rs538719629, rs538856385, rs539014522, rs539110487, rs539380013, rs539468342, rs539558334, rs539723740, rs539797071, rs539967957, rs540118139, rs540262740, rs540414225, rs540448686, rs540833632, rs540877234, rs540877830, rs540911894, rs540943749, rs541055967, rs541073541, rs541299023, rs541449650, rs541537384, rs541807865, rs541841155, rs541897718, rs542322730, rs542436190, rs542466976, rs542520858, rs542570988, rs542720789, rs542922281, rs543329741, rs543370993, rs543456744, rs543802677, rs543919081, rs543940794, rs544071266, rs544365402, rs544368608, rs544410518, rs544410836, rs544448494, rs544905777, rs544938122, rs545104656, rs545271894, rs545349538, rs545438074, rs545438123, rs546016309, rs546260863, rs546323421, rs546376402, rs547778415, rs547846849, rs547867709, rs547885527, rs547968529, rs548079477, rs548161414, rs548396303, rs548756390, rs548929399, rs548945470, rs549100277, rs549142397, rs549834851, rs549995044, rs550028183, rs550073930, rs550107422, rs550857471, rs550915196, rs550992644, rs550996386, rs551078742, rs551592000, rs551713029, rs551724597, rs551798084, rs552064079, rs552184470, rs552697544, rs552738572, rs552850691, rs547441462, rs547112247, rs546983953, rs546875049, rs546466375, rs546417010, rs546378331, rs552923753, rs553072849, rs553310926, rs553602736, rs553760068, rs553793163, rs553866555, rs553908683, rs554046976, rs554078433, rs554409602, rs554451844, rs554782032, rs555035210, rs555042960, rs555455408, rs555571688, rs555835721, rs555903665, rs555980737, rs556070337, rs556242786, rs556306222, rs556306503, rs556475744, rs556748323, rs557073963, rs557108466, rs557241953, rs557387508, rs557434200, rs557461086, rs557610631, rs558084054, rs558182614, rs558202780, rs558231853, rs558292964, rs558294899, rs558330360, rs558513244, rs558953933, rs559102087, rs559483603, rs559542629, rs559924290, rs560225721, rs560270873, rs560366032, rs560379930, rs560407738, rs560476139, rs560548493, rs561318435, rs561600004, rs561715780, rs562248093, rs562265516, rs562446256, rs562578337, rs562580870, rs562685254, rs562730568, rs562794616, rs562931210, rs562955779, rs563005151, rs563014439, rs563091520, rs563093147, rs563208176, rs563600965, rs563639504, rs563773522, rs563790636, rs563853837, rs563889760, rs564138931, rs564461174, rs564535411, rs564575395, rs564644984, rs564809875, rs564839085, rs564848510, rs564922369, rs565045308, rs565490655, rs565683921, rs565948960, rs566271985, rs566465559, rs566728183, rs566769575, rs566891487, rs566928694, rs566944947, rs566953664, rs566986521, rs567294414, rs567308384, rs567402015, rs567463643, rs567651225, rs567708710, rs568061033, rs568220391, rs568227769, rs568241298, rs568389697, rs568725951, rs569133278, rs569288698, rs569335925, rs569363032, rs569378426, rs569402782, rs569613224, rs569618690, rs570251619, rs570326099, rs570329813, rs570604735, rs570648500, rs571077663, rs571108752, rs571236000, rs571359815, rs571420864, rs571522042, rs571876720, rs571940488, rs572166519, rs572214888, rs572363136, rs572527369, rs572687257, rs573270795, rs573367793, rs573405328, rs573455326, rs573465617, rs573715107, rs573883571, rs574106259, rs574248181, rs574350498, rs574862256, rs574872059, rs574894754, rs574926836, rs575137886, rs575674171, rs575870524, rs576181574, rs576275667, rs576719987, rs576720162, rs577011007, rs577023175, rs577407924, rs577720921, rs577797978, rs577800522, rs577806343, rs577880164, rs577906096, rs577918795, rs578216431, rs745306850, rs745306861, rs745419505, rs745426085, rs745444949, rs745511852, rs745533728, rs745551727, rs745618018, rs745627220, rs745710183, rs745761477, rs745816219, rs745816355, rs745882425, rs745890471, rs745897683, rs745956207, rs745956774, rs745965625, rs746002871, rs746020263, rs746058533, rs746068022, rs746150760, rs746244895, rs746245709, rs746326156, rs746361123, rs746387733, rs746463069, rs746477554, rs746525316, rs746631257, rs746671374, rs746733885, rs746760406, rs746769693, rs746806801, rs746827007, rs746859702, rs746883969, rs746893543, rs746924059, rs746947825, rs747008057, rs747038879, rs747095961, rs747098258, rs747148534, rs747173302, rs747300481, rs747338144, rs747342259, rs747354016, rs747387196, rs747391169, rs747534233, rs747611318, rs747646491, rs747660548, rs747728750, rs747733556, rs747807494, rs747809048, rs747899948, rs747948522, rs747951577, rs747953612, rs748013570, rs748043131, rs748156659, rs748202022, rs748255432, rs748301943, rs748509676, rs748520738, rs748564718, rs748588464, rs748653489, rs748665297, rs748677206, rs748789502, rs748798324, rs748817525, rs748820854, rs748946901, rs749012764, rs749084260, rs749101279, rs749138289, rs749164572, rs749240455, rs749314383, rs749432012, rs749435918, rs749436007, rs749463421, rs749511762, rs749535904, rs749607771, rs749621660, rs749651871, rs749736899, rs749800225, rs749863195, rs749912018, rs749966010, rs749991246, rs749999803, rs750005559, rs750007435, rs750153057, rs750247123, rs750301530, rs750336532, rs750399742, rs750399947, rs750453350, rs750454050, rs750484873, rs750566089, rs750572766, rs750635086, rs750668023, rs750743574, rs750889782, rs750895890, rs750904732, rs750906839, rs750967765, rs751090137, rs751132098, rs751263915, rs751295073, rs751340355, rs751389375, rs751520851, rs751582497, rs751705225, rs751794453, rs751802666, rs751811525, rs751822337, rs751882664, rs751992560, rs751995887, rs752037112, rs752057528, rs752088799, rs752141508, rs752146300, rs752269926, rs752327486, rs752420414, rs752521534, rs752607737, rs752627946, rs752715015, rs752736704, rs752751984, rs752758326, rs752784361, rs752804462, rs752812981, rs752820485, rs752935089, rs752946790, rs752996693, rs753057356, rs753164211, rs753166398, rs753166496, rs753167035, rs753220125, rs753282322, rs753291515, rs753328828, rs753445019, rs753447830, rs753468278, rs753488664, rs753507183, rs753600757, rs753620111, rs753660903, rs753750417, rs753766842, rs753855098, rs753886745, rs753928228, rs754025464, rs754134176, rs754170292, rs754170656, rs754193560, rs754266653, rs754274583, rs754320374, rs754329901, rs754431996, rs754473375, rs754581545, rs754709344, rs754717527, rs754747609, rs754800041, rs754833828, rs754841103, rs754869603, rs754954638, rs754964975, rs754978631, rs755056200, rs755071207, rs755072380, rs755088085, rs755150485, rs755184357, rs755223158, rs755324667, rs755329222, rs755414746, rs755454531, rs755464893, rs755515660, rs755519877, rs755548192, rs755696177, rs755696904, rs755768308, rs755787827, rs755908164, rs755999834, rs756031060, rs756031378, rs756042293, rs756042481, rs756044745, rs756121043, rs756123157, rs756135232, rs756210907, rs756319569, rs756393266, rs756464199, rs756464730, rs756478965, rs756575304, rs756639026, rs756677163, rs756693094, rs756695371, rs756730335, rs756733337, rs756787049, rs756851759, rs757041611, rs757104555, rs757158931, rs757230483, rs757250994, rs757251193, rs757257247, rs757259115, rs757273041, rs757310094, rs757387072, rs757466277, rs757508954, rs757525165, rs757589496, rs757657345, rs757720386, rs757724509, rs757823463, rs757835419, rs757871358, rs757884734, rs757925587, rs757948866, rs757949564, rs758113854, rs758260297, rs758326916, rs758442320, rs758522855, rs758602959, rs758629545, rs758645364, rs758659507, rs758775976, rs758841128, rs758931689, rs758939310, rs758941038, rs758982450, rs759011004, rs759075619, rs759135596, rs759158538, rs759173115, rs759220063, rs759253167, rs759280279, rs759370090, rs759501515, rs759511711, rs759516562, rs759544156, rs759562174, rs759564156, rs759619180, rs759723474, rs759731211, rs759777872, rs759778209, rs759948249, rs759949982, rs759951639, rs759957436, rs760016257, rs760105515, rs760107054, rs760126408, rs760126540, rs760126924, rs760179252, rs760202269, rs760285694, rs760307098, rs760397638, rs760426420, rs760472338, rs760494327, rs760501583, rs760521771, rs760662744, rs760681687, rs760765585, rs760766230, rs760877146, rs760937197, rs760943859, rs761039951, rs761153188, rs761200249, rs761213112, rs761309365, rs761408010, rs761445993, rs761448586, rs761484472, rs761498977, rs761513763, rs761529451, rs761542444, rs761543634, rs761631031, rs761751647, rs761796768, rs761828482, rs761859611, rs761882804, rs761913009, rs761914605, rs761934425, rs761968706, rs762006599, rs762125685, rs762211580, rs762226529, rs762283787, rs762303998, rs762483687, rs762546467, rs762570628, rs762582573, rs762618243, rs762627114, rs762771301, rs762876977, rs762943482, rs762981013, rs763034153, rs763047690, rs763099634, rs763214827, rs763214846, rs763350634, rs763362455, rs763381837, rs763389143, rs763444638, rs763497680, rs763522643, rs763568920, rs763608460, rs763697863, rs763712712, rs763774686, rs763799379, rs763851107, rs763859635, rs763890649, rs763907879, rs763914758, rs763945017, rs764046799, rs764072081, rs764099561, rs764174190, rs764280512, rs764286466, rs764334726, rs764336613, rs764439180, rs764473740, rs764522054, rs764579879, rs764591974, rs764680965, rs764715821, rs764749298, rs764794547, rs764858224, rs764905877, rs764907748, rs764954235, rs764991426, rs765048134, rs765051553, rs765079532, rs765119055, rs765174065, rs765189820, rs765235904, rs765243245, rs765266637, rs765331376, rs765350640, rs765369504, rs765431582, rs765432253, rs765439946, rs765463082, rs765520038, rs765682027, rs765774591, rs765812814, rs765886731, rs765906787, rs765910207, rs765914203, rs765926917, rs765964805, rs766104084, rs766125236, rs766286225, rs766338743, rs766418873, rs766418901, rs766422289, rs766482364, rs766557426, rs766570845, rs766640359, rs766646217, rs766822218, rs766828774, rs766837655, rs766859707, rs766944930, rs766981529, rs767009640, rs767033042, rs767060337, rs767214355, rs767258249, rs767305032, rs767312106, rs767360120, rs767392013, rs767561967, rs767768129, rs767771897, rs767788419, rs767799735, rs767800023, rs768080447, rs768083210, rs768206746, rs768284541, rs768365237, rs768390959, rs768417052, rs768465375, rs768538403, rs768597548, rs768706642, rs768812125, rs768813846, rs768915855, rs768994065, rs769017393, rs769018282, rs769023061, rs769024262, rs769069042, rs769129492, rs769214729, rs769217873, rs769219806, rs769385677, rs769551807, rs769597716, rs769622690, rs769648456, rs769731197, rs769749617, rs769801596, rs769809024, rs769818541, rs769964799, rs770016889, rs770035607, rs770045903, rs770119513, rs770148893, rs770164381, rs770181308, rs770255396, rs770266116, rs770358984, rs770374274, rs770484034, rs770512665, rs770587800, rs770719238, rs770740012, rs770747229, rs770786181, rs770873775, rs770915628, rs770989683, rs771077016, rs771080028, rs771112679, rs771139931, rs771232307, rs771248299, rs771261012, rs771288323, rs771338362, rs771406749, rs771426657, rs771554986, rs771641368, rs771645454, rs771698726, rs771734877, rs771741738, rs771764405, rs771769796, rs771806866, rs771962267, rs772051916, rs772112577, rs772165419, rs772221900, rs772228903, rs772230274, rs772235737, rs772242251, rs772299197, rs772311336, rs772442561, rs772444228, rs772504493, rs772514611, rs772640099, rs772765835, rs772792838, rs772808446, rs772890193, rs772986241, rs773030462, rs773037460, rs773078701, rs773211045, rs773305880, rs773307918, rs773327031, rs773348446, rs773394059, rs773403637, rs773415492, rs773475926, rs773516984, rs773563136, rs773787822, rs773808646, rs773811368, rs773849840, rs773886266, rs773905916, rs774012066, rs774207880, rs774229738, rs774240595, rs774420737, rs774430952, rs774554121, rs774560137, rs774564791, rs774569101, rs774588330, rs774615995, rs774688311, rs774767443, rs774868695, rs774903867, rs774923254, rs774925684, rs774934785, rs774980016, rs775007490, rs775044013, rs775105018, rs775192787, rs775203380, rs775228379, rs775258389, rs775299640, rs775339427, rs775394437, rs775415473, rs775550206, rs775635196, rs775689438, rs775738104, rs775825051, rs775878558, rs775878637, rs776042543, rs776073853, rs776083430, rs776152947, rs776276813, rs776278329, rs776298636, rs776418340, rs776439113, rs776470314, rs776563297, rs776624188, rs776680792, rs776737538, rs776745208, rs776773228, rs776783496, rs776785502, rs776817542, rs776826689, rs776845104, rs776893288, rs776947384, rs776974102, rs777075412, rs777136217, rs777208445, rs777306136, rs777336060, rs777397193, rs777406730, rs777432099, rs777436847, rs777539780, rs777662187, rs777697046, rs777699097, rs777700238, rs777727222, rs777758286, rs777766926, rs777892234, rs777954711, rs777997008, rs778040387, rs778107598, rs778177112, rs778378811, rs778615261, rs778664525, rs778719428, rs778736663, rs778752848, rs778875311, rs778909991, rs779017511, rs779132852, rs779224998, rs779231833, rs779241028, rs779246332, rs779286579, rs779327088, rs779428964, rs779431480, rs779480027, rs779602583, rs779666069, rs779707457, rs779735498, rs779783880, rs779788849, rs779855597, rs779870173, rs779924630, rs780014587, rs780072959, rs780088411, rs780219814, rs780266997, rs780323328, rs780368194, rs780386793, rs780391826, rs780426461, rs780449707, rs780510809, rs780533501, rs780537281, rs780542223, rs780546534, rs780550917, rs780687906, rs780834162, rs780858451, rs780880744, rs780953815, rs780955201, rs780965711, rs781010216, rs781017028, rs781078843, rs781114491, rs781136461, rs781224455, rs781230982, rs781409321, rs781411576, rs781514479, rs781534991, rs781635721, rs781660401, rs781678909, rs781682041, rs781725943, VAR_003437, VAR_009129, VAR_009130, VAR_009131, VAR_009134, VAR_009135, VAR_015373, VAR_023770, VAR_023771, VAR_042230, VAR_042231, VAR_067170, VAR_067171, VAR_067172, VAR_067174, VAR_067175, VAR_067176, VAR_067177, VAR_067178, VAR_067179, VAR_067180, VAR_067181, VAR_067182, VAR_071605, VAR_071606, VAR_071607, and VAR_071608.

There are various mutations associated with CORD, which can be insertions, deletions, missense, nonsense, frameshift and other mutations, with the common effect of inactivating the GUCY2D gene. Any one or more of the mutations can be repaired to restore RetGC1 protein activity. For example, the pathological variants, R838H, R838C, or R838S, can be restored or corrected (See Table 3).

TABLE 3

| Variant | Location | Variant type |
|---------|----------|--------------|
| R838H | 8,014,701 | missense |
| R838C | 8,014,700 | missense |
| R838S | 8,014,700 | missense |

Exon Deletion

Another genome engineering strategy involves exon deletion. Targeted deletion of specific exons can be an attractive strategy for treating a large subset of patients with a single therapeutic cocktail. Deletions can either be single exon deletions or multi-exon deletions. While multi-exon deletions can reach a larger number of patients, for larger deletions the efficiency of deletion greatly decreases with increased size. Therefore, deletions range can be from 40 to 10,000 base pairs (bp) in size. For example, deletions can range from 40-100; 100-300; 300-500; 500-1,000; 1,000-2,000; 2,000-3,000; 3,000-5,000; or 5,000-10,000 base pairs in size.

As stated previously, the GUCY2D gene contains 20 exons. Any one or more of the 20 exons can contain a mutation. Any one or more of the 20 mutated exons, or aberrant intronic splice acceptor or donor sites, can be deleted to restore or partially restore the GUCY2D function. In some examples, the methods provide gRNA pairs that can be used to delete any one or more of the mutated exons 1, 2, 3, 4, 5, 6, 7, 8, 9, 10, 11, 12, 13, 14, 15, 16, 17, 18, 19, 20, or any combinations thereof.

To ensure that the pre-mRNA is properly processed following deletion, the surrounding splicing signals can be deleted. Splicing donor and acceptors are generally within 100 base pairs of the neighboring intron. Therefore, in some examples, methods can provide all gRNAs that cut approximately +/−100-3100 bp with respect to each exon/intron junction of interest.

For any of the genome editing strategies, gene editing can be confirmed by sequencing or PCR analysis.

In Vivo Based Therapy

Provided herein are methods for treating a patient with autosomal dominant CORD. In some aspects, the method is an in vivo cell-based therapy. Chromosomal DNA of the cells in the autosomal dominant CORD patient can be edited using the materials and methods described herein. For example, the in vivo method can comprise editing a R838H, R838C, or R838S mutation in a GUCY2D gene in a cell of a patient, such as photoreceptor cells or retinal progenitor cells.

Although certain cells present an attractive target for ex vivo treatment and therapy, increased efficacy in delivery may permit direct in vivo delivery to such cells. Ideally the targeting and editing would be directed to the relevant cells. Cleavage in other cells can also be prevented by the use of promoters only active in certain cells and or developmental stages. Additional promoters are inducible, and therefore can be temporally controlled if the nuclease is delivered as a plasmid. The amount of time that delivered RNA and protein remain in the cell can also be adjusted using treatments or domains added to change the half-life. In vivo treatment would eliminate a number of treatment steps, but a lower rate of delivery can require higher rates of editing. In vivo treatment can eliminate problems and losses from ex vivo treatment and engraftment.

An advantage of in vivo gene therapy can be the ease of therapeutic production and administration. The same therapeutic approach and therapy will have the potential to be used to treat more than one patient, for example a number of patients who share the same or similar genotype or allele. In contrast, ex vivo cell therapy typically requires using a patient's own cells, which are isolated, manipulated and returned to the same patient.

Ex Vivo Based Therapy

Provided herein are methods for treating a patient with autosomal dominant CORD. An aspect of such method is an ex vivo cell-based therapy. For example, a patient-specific induced pluripotent stem cell (iPSC) can be created. Then, the chromosomal DNA of these iPSC cells can be edited using the materials and methods described herein. For example, the method can comprise editing within or near a R838H, R838C, or R838S mutation in the GUCY2D gene of the iPSC. Next, the genome-edited iPSCs can be differentiated into other cells, such as photoreceptor cells or retinal progenitor cells. Finally, the differentiated cells, such as photoreceptor cell or retinal progenitor cell, can be implanted into the patient.

Another aspect of such method is an ex vivo cell-based therapy. For example, photoreceptor cells or retinal progenitor cells can be isolated from the patient. Next, the chromosomal DNA of these photoreceptor cells or retinal progenitor cells can be edited using the materials and methods described herein. For example, the method can comprise editing within or near a R838H, R838C, or R838S mutation in the GUCY2D gene of the photoreceptor cells or retinal progenitor cells. Finally, the genome-edited photoreceptor cells or retinal progenitor cells can be implanted into the patient.

Another aspect of such method is an ex vivo cell-based therapy. For example, a mesenchymal stem cell can be isolated from the patient, which can be isolated from the patient's bone marrow or peripheral blood. Next, the chromosomal DNA of these mesenchymal stem cells can be edited using the materials and methods described herein. For example, the method can comprise editing within or near a R838H, R838C, or R838S mutation in the GUCY2D gene of the mesenchymal stem cells. Next, the genome-edited mesenchymal stem cells can be differentiated into any type of cell, e.g., photoreceptor cells or retinal progenitor cells. Finally, the differentiated cells, e.g., photoreceptor cells or retinal progenitor cells can be implanted into the patient.

One advantage of an ex vivo cell therapy approach is the ability to conduct a comprehensive analysis of the therapeutic prior to administration. Nuclease-based therapeutics can have some level of off-target effects. Performing gene correction ex vivo allows one to characterize the corrected cell population prior to implantation. The present disclosure includes sequencing the entire genome of the corrected cells to ensure that the off-target effects, if any, can be in genomic locations associated with minimal risk to the patient. Furthermore, populations of specific cells, including clonal populations, can be isolated prior to implantation.

Another advantage of ex vivo cell therapy relates to genetic correction in iPSCs compared to other primary cell sources. iPSCs are prolific, making it easy to obtain the large number of cells that will be required for a cell-based therapy. Furthermore, iPSCs are an ideal cell type for performing clonal isolations. This allows screening for the correct genomic correction, without risking a decrease in viability. In contrast, other primary cells, such as photoreceptor cells or retinal progenitor cells, are viable for only a few passages and difficult to clonally expand. Thus, manipulation of iPSCs for the treatment of autosomal dominant CORD can be much easier, and can shorten the amount of time needed to make the desired genetic correction.

Genome Editing

Genome editing refers to the process of modifying the nucleotide sequence of a genome, such as in a precise or pre-determined manner. Examples of methods of genome editing described herein include methods of using site-directed nucleases to cut DNA at precise target locations in the genome, thereby creating single-strand or double-strand DNA breaks at particular locations within the genome. Such breaks can be and regularly are repaired by natural, endogenous cellular processes, such as HDR and NHEJ. These two main DNA repair processes consist of a family of alternative pathways. NHEJ directly joins the DNA ends resulting from a double-strand break, sometimes with the loss or addition of nucleotide sequence, which may disrupt or enhance gene expression. HDR utilizes a homologous sequence, or donor sequence, as a template for inserting a defined DNA sequence at the break point. The homologous sequence can be in the endogenous genome, such as a sister chromatid. Alternatively, the donor can be an exogenous nucleic acid, such as a plasmid, a single-strand oligonucleotide, a double-stranded oligonucleotide, a duplex oligonucleotide or a virus, that has regions of high homology with the nuclease-cleaved locus, but which can also contain additional sequence or sequence changes including deletions that can be incorporated into the cleaved target locus. A third repair mechanism can be microhomology-mediated end joining (MMEJ), also referred to as "Alternative NHEJ (ANHEJ)", in which the genetic outcome is similar to NHEJ in that small deletions and insertions can occur at the cleavage site. MMEJ can make use of homologous sequences of a few base pairs flanking the DNA break site to drive a more favored DNA end joining repair outcome, and recent reports have further elucidated the molecular mechanism of this process. In some instances, it may be possible to predict likely repair outcomes based on analysis of potential microhomologies at the site of the DNA break.

Each of these genome editing mechanisms can be used to create desired genomic alterations. A step in the genome editing process can be to create one or two DNA breaks, the latter as double-strand breaks or as two single-stranded breaks, in the target locus as near the site of intended mutation. This can be achieved via the use of site-directed polypeptides, as described and illustrated herein.

Site-directed polypeptides, such as a DNA endonuclease, can introduce double-strand breaks or single-strand breaks in nucleic acids, e.g., genomic DNA. The double-strand break can stimulate a cell's endogenous DNA-repair pathways [e.g., homology-dependent repair (HDR) or non-homologous end joining (NHEJ) or (ANHEJ) or (MMEJ)]. NHEJ can repair cleaved target nucleic acid without the need for a homologous template. This can sometimes result in small deletions or insertions (indels) in the target nucleic acid at the site of cleavage, and can lead to disruption or alteration of gene expression. The deletions range can be from 40 to 10,000 base pairs (bp) in size. For example, deletions can range from 40-100; 100-300; 300-500; 500-1,000; 1,000-2,000; 2,000-3,000; 3,000-5,000; or 5,000-10,000 base pairs in size. HDR can occur when a homologous repair template, or donor, is available. The homologous donor template can comprise at least a portion of the wild-type GUCY2D gene, or cDNA. The at least a portion of the wild-type GUCY2D gene or cDNA can be exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, intronic regions, fragments or combinations thereof, or the entire GUCY2D gene or cDNA. The donor template can be either a single or double stranded polynucleotide. The donor template can be up to 5 KB. The donor template can be up to 4 KB. The donor template can be up to 3 KB. The donor template can be up to 2 KB. The donor template can be up to 1 KB. The donor template can be delivered by AAV. The homologous donor template can comprise sequences that can be homologous to sequences flanking the target nucleic acid cleavage site. For example, the donor template can have homologous arms to the 17p13.1 region. The donor template can also have homologous arms to the pathological variant R838H, R838C, or R838S. The sister chromatid can be used by the cell as the repair template. However, for the purposes of genome editing, the repair template can be supplied as an exogenous nucleic acid, such as a plasmid, duplex oligonucleotide, single-strand oligonucleotide, double-stranded oligonucleotide, or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ, in that small deletions and insertions can occur at the cleavage site. MMEJ can make use of homologous sequences of a few base pairs flanking the cleavage site to drive a favored end-joining DNA repair outcome. In some instances, it may be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous polynucleotide sequence is termed a donor polynucleotide (or donor or donor sequence or polynucleotide donor template) herein. The donor polynucleotide, a portion of the donor polynucleotide, a copy of the donor polynucleotide, or a portion of a copy of the donor polynucleotide can be inserted into the target nucleic acid cleavage site. The donor polynucleotide can be an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats." When expressed, the repeats can form secondary structures (e.g., hairpins) and/or comprise unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Type II CRISPR Systems crRNA biogenesis in a Type II CRISPR system in nature requires a trans-activating CRISPR RNA (tracrRNA). The tracrRNA can be modified by endogenous RNaseIII, and then hybridizes to a crRNA repeat in the pre-crRNA array. Endogenous RNaseIII can be recruited to cleave the pre-crRNA. Cleaved crRNAs can be subjected to exoribonuclease trimming to produce the mature crRNA form (e.g., 5' trimming). The tracrRNA can remain hybridized to the crRNA, and the tracrRNA and the crRNA associate with a site-directed polypeptide (e.g., Cas9). The crRNA of the crRNA-tracrRNA-Cas9 complex can guide the complex to a target nucleic acid to which the crRNA can hybridize. Hybridization of the crRNA to the target nucleic acid can activate Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., *Science*, 337(6096):816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays can be processed into mature crRNAs without the requirement of an additional trans-activating tracrRNA. The Type V CRISPR array can be processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems can start with 20-24 nucleotides of spacer sequence followed by about 22 nucleotides of direct repeat. Also, Cpf1 can utilize a T-rich protospacer-adjacent motif such that Cpf1-crRNA complexes efficiently cleave target DNA preceded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Figure 1B:
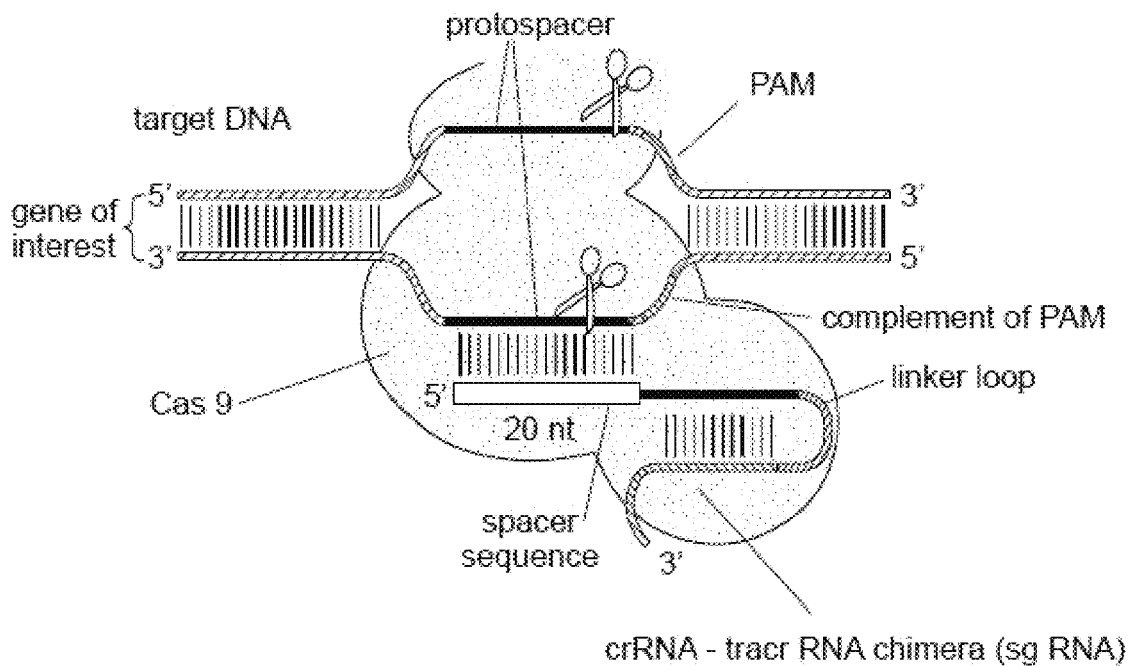
Figure 3A:
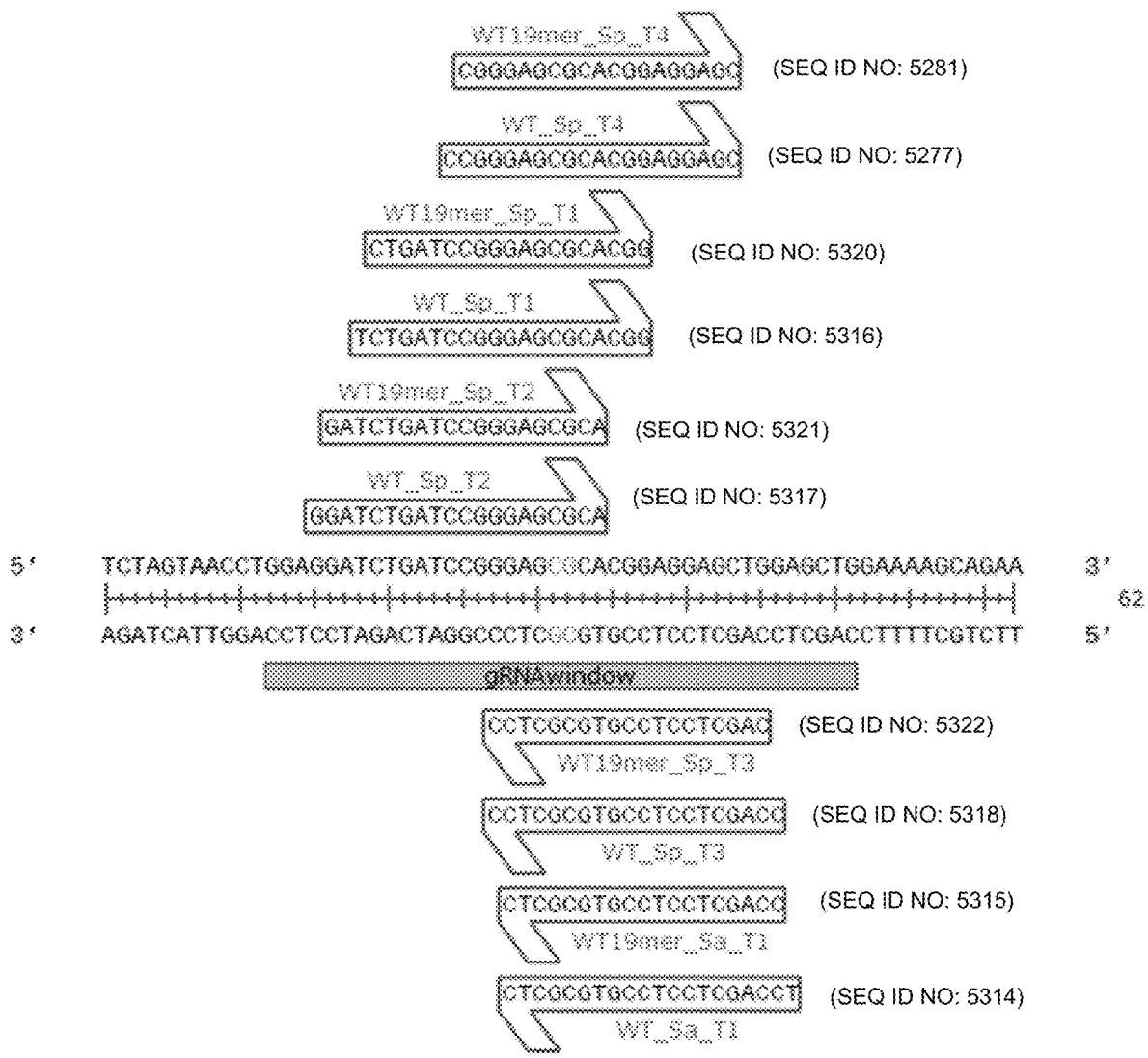
Figure 3B:
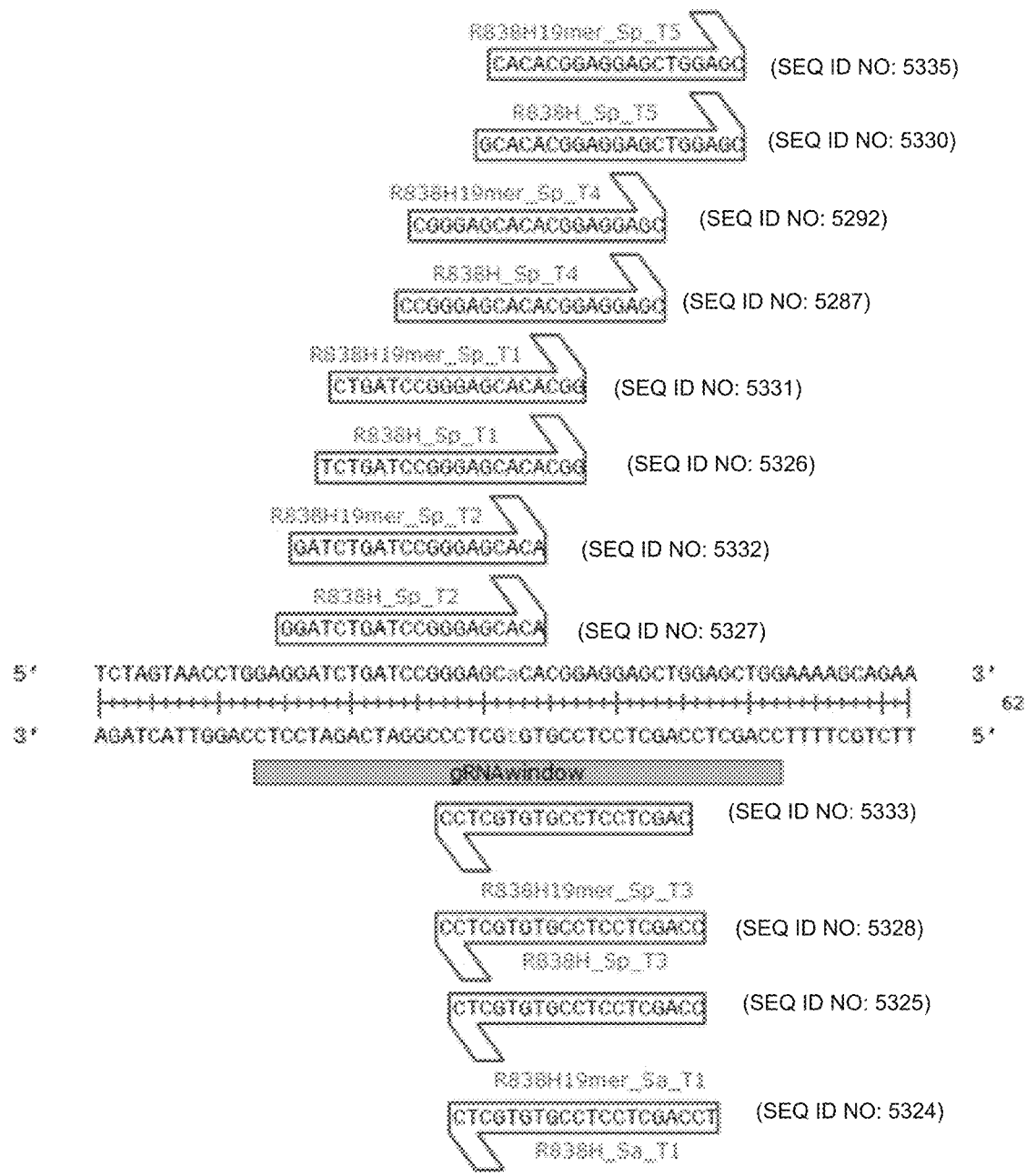
Figure 3D:
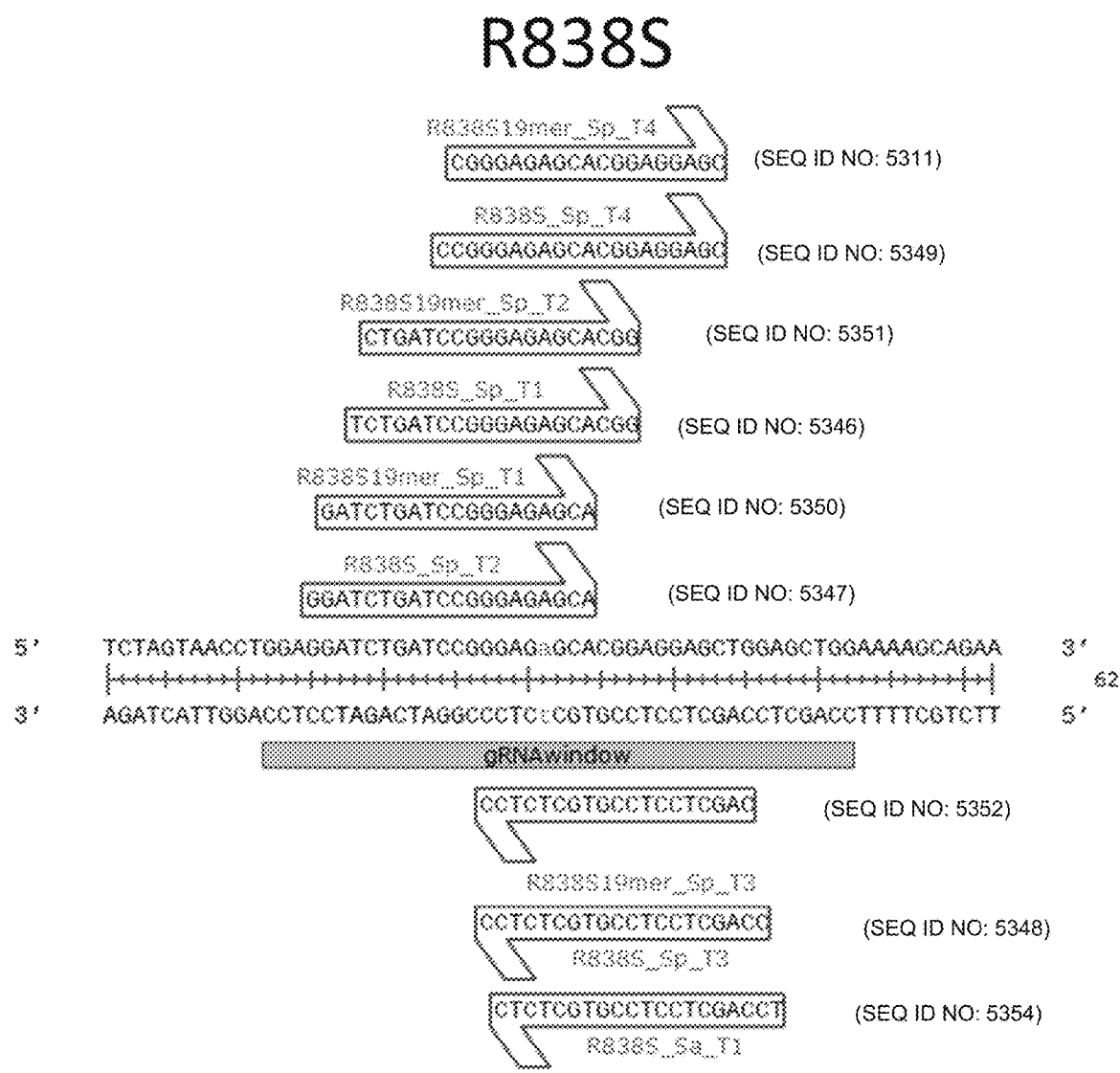
Figure 3E:
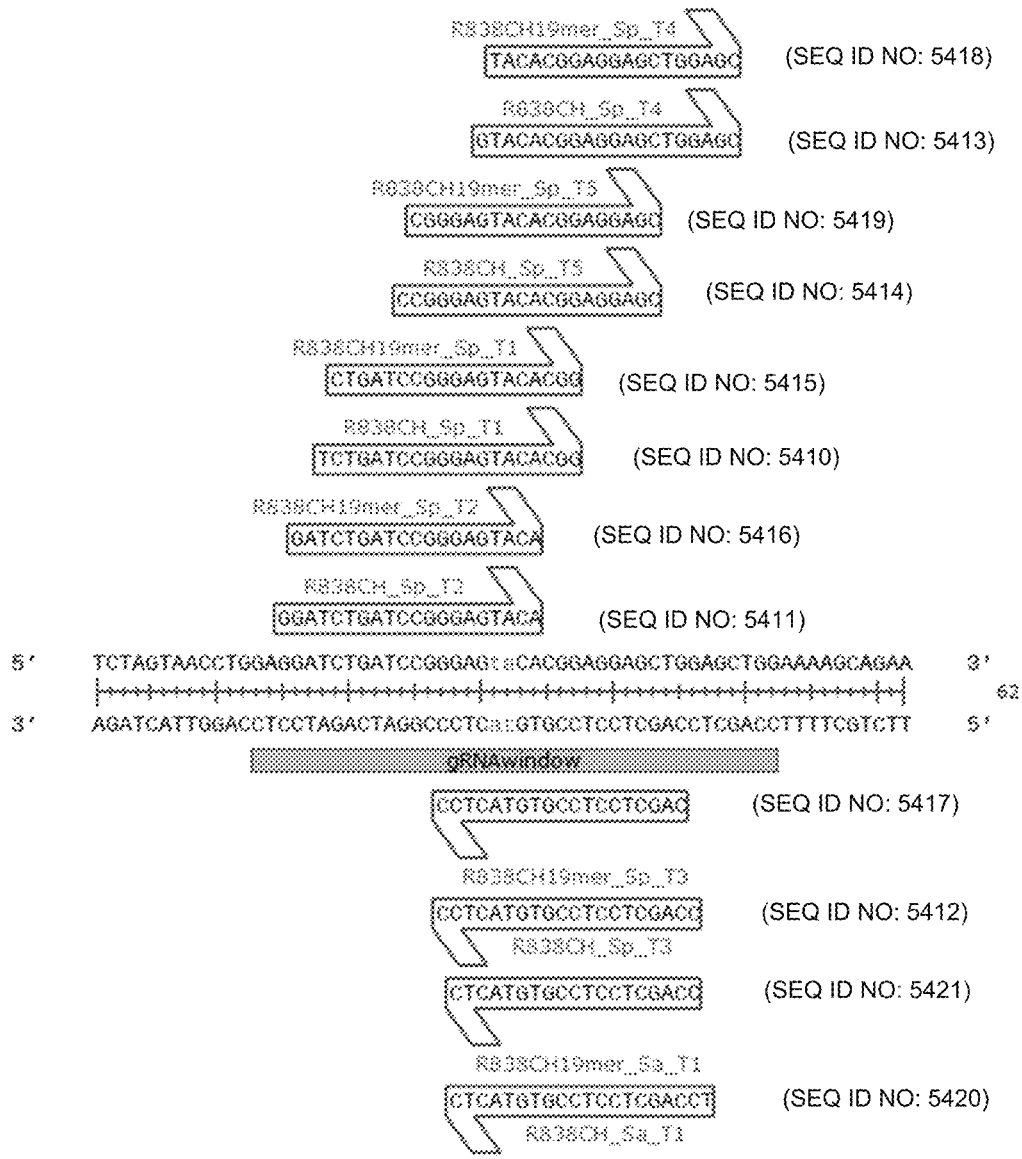
Figure 3F:
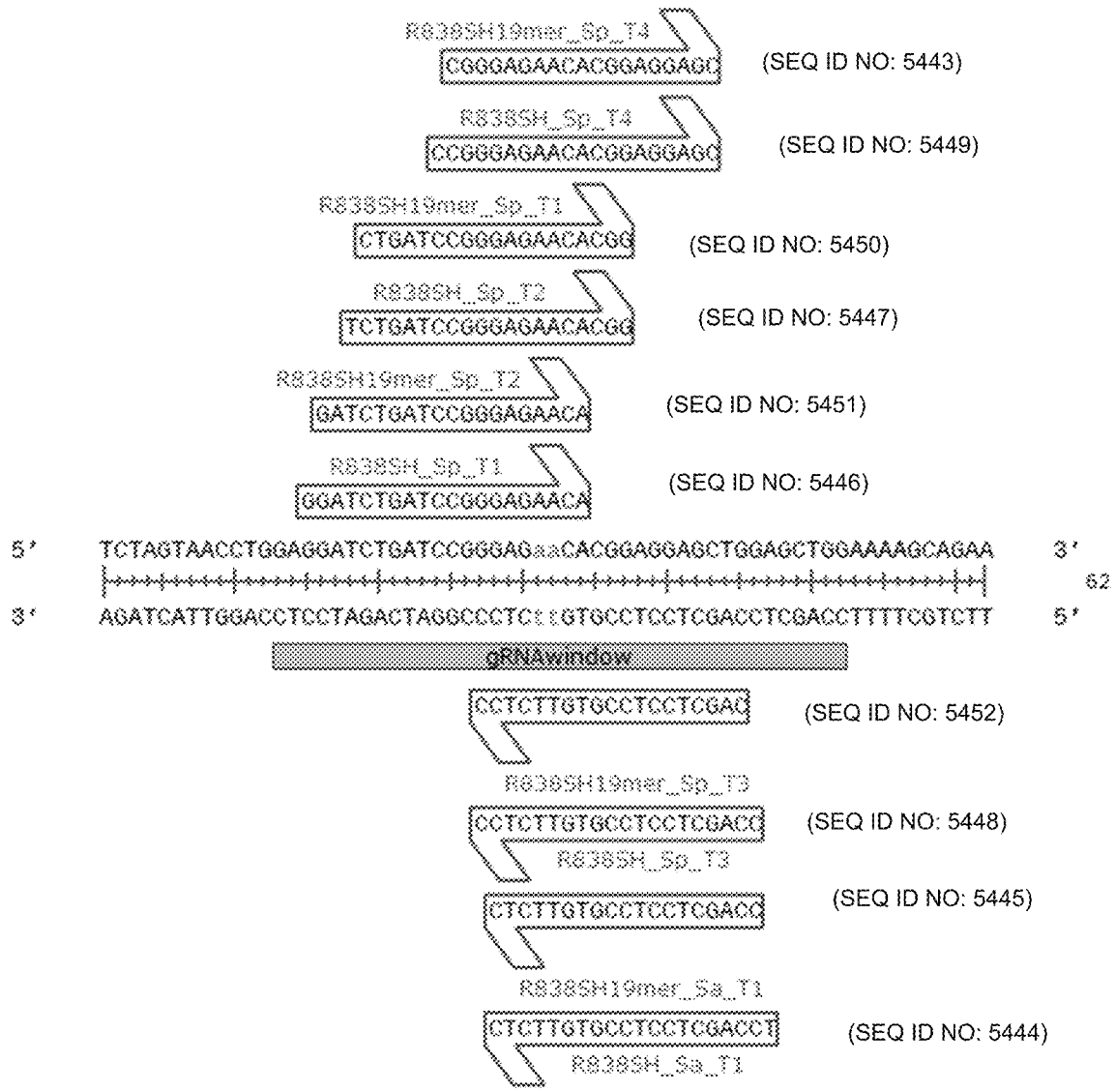
Figure 4A:
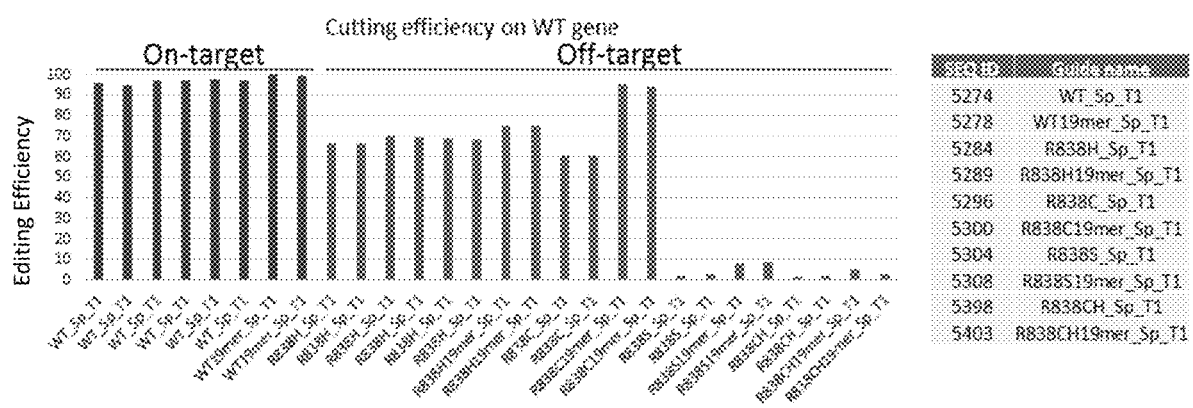
FIGS. 4A-E describe the on-target editing efficiency of sgRNAs targeting the wild-type GUCY2D gene and the off-target editing efficiency of sgRNAs targeting the R838H, R838C, or R838S mutation within the GUCY2D gene.
Figure 4B:
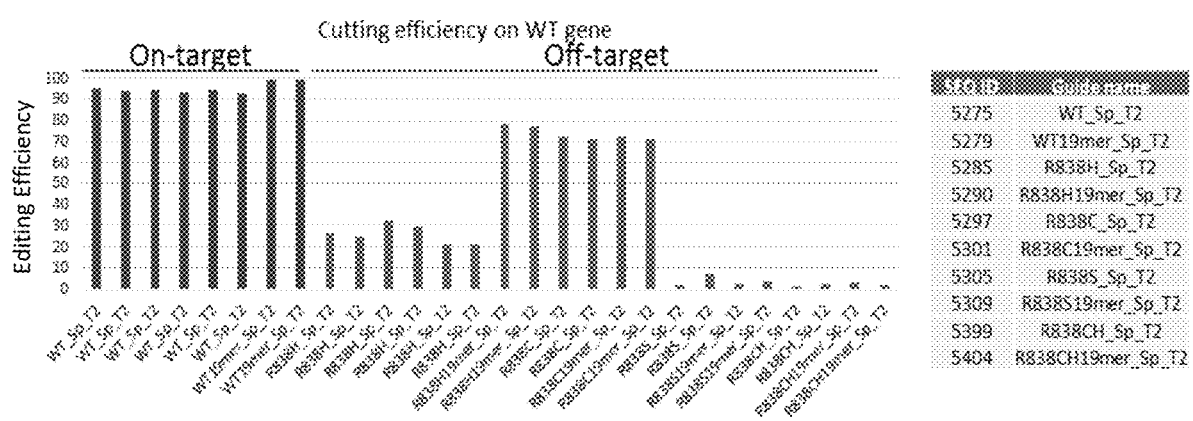
Figure 4C:
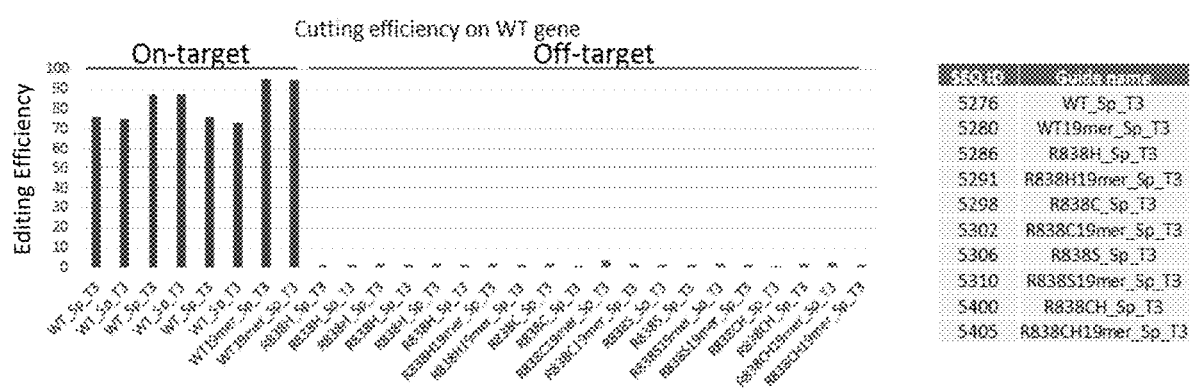
Figure 4D:
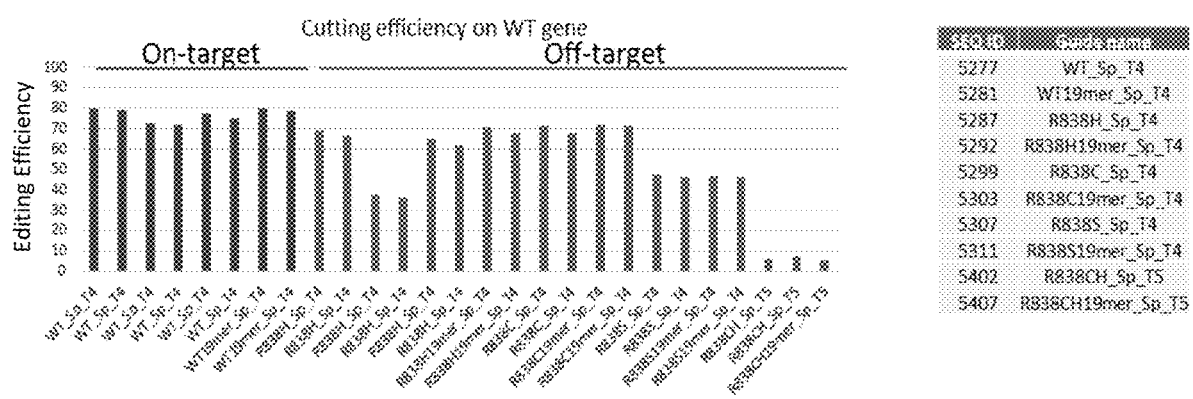
Figure 4E:
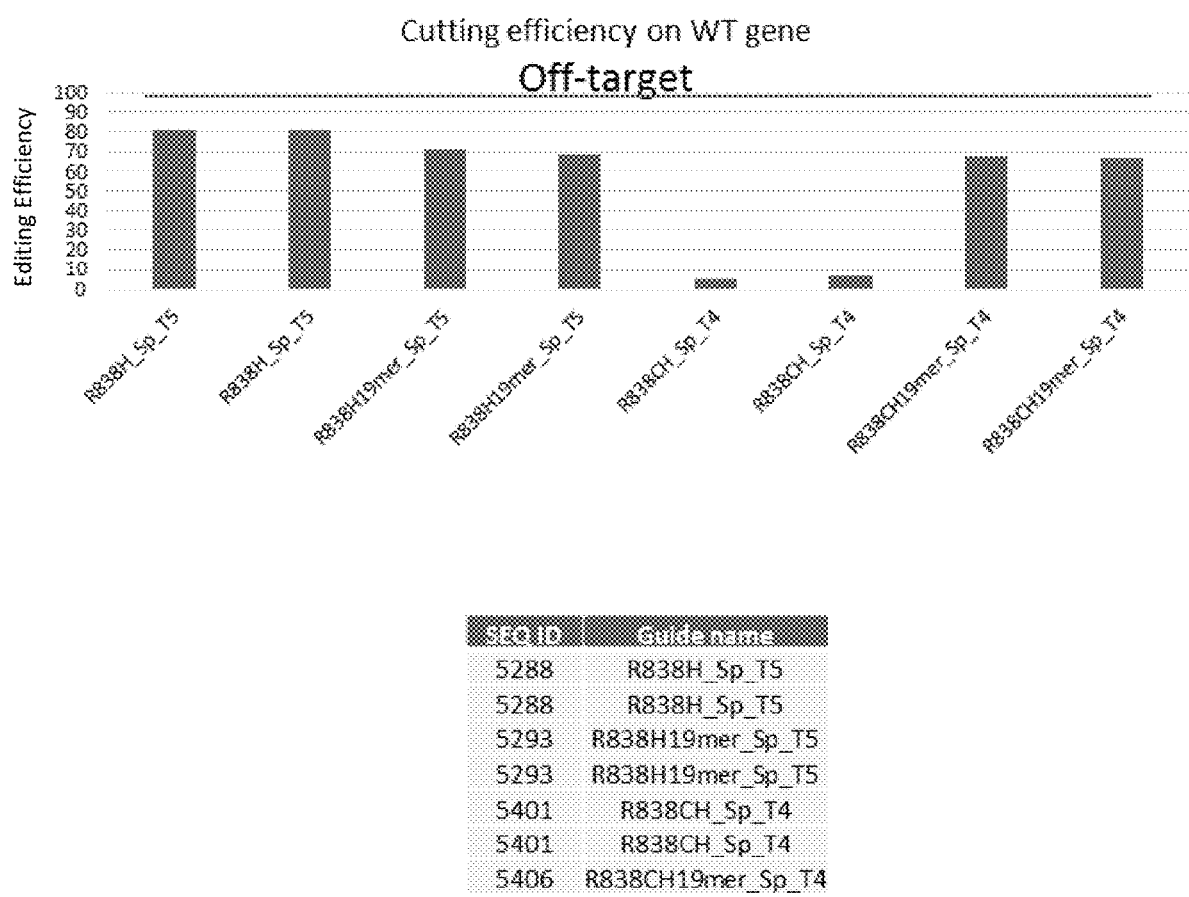
Figure 5:
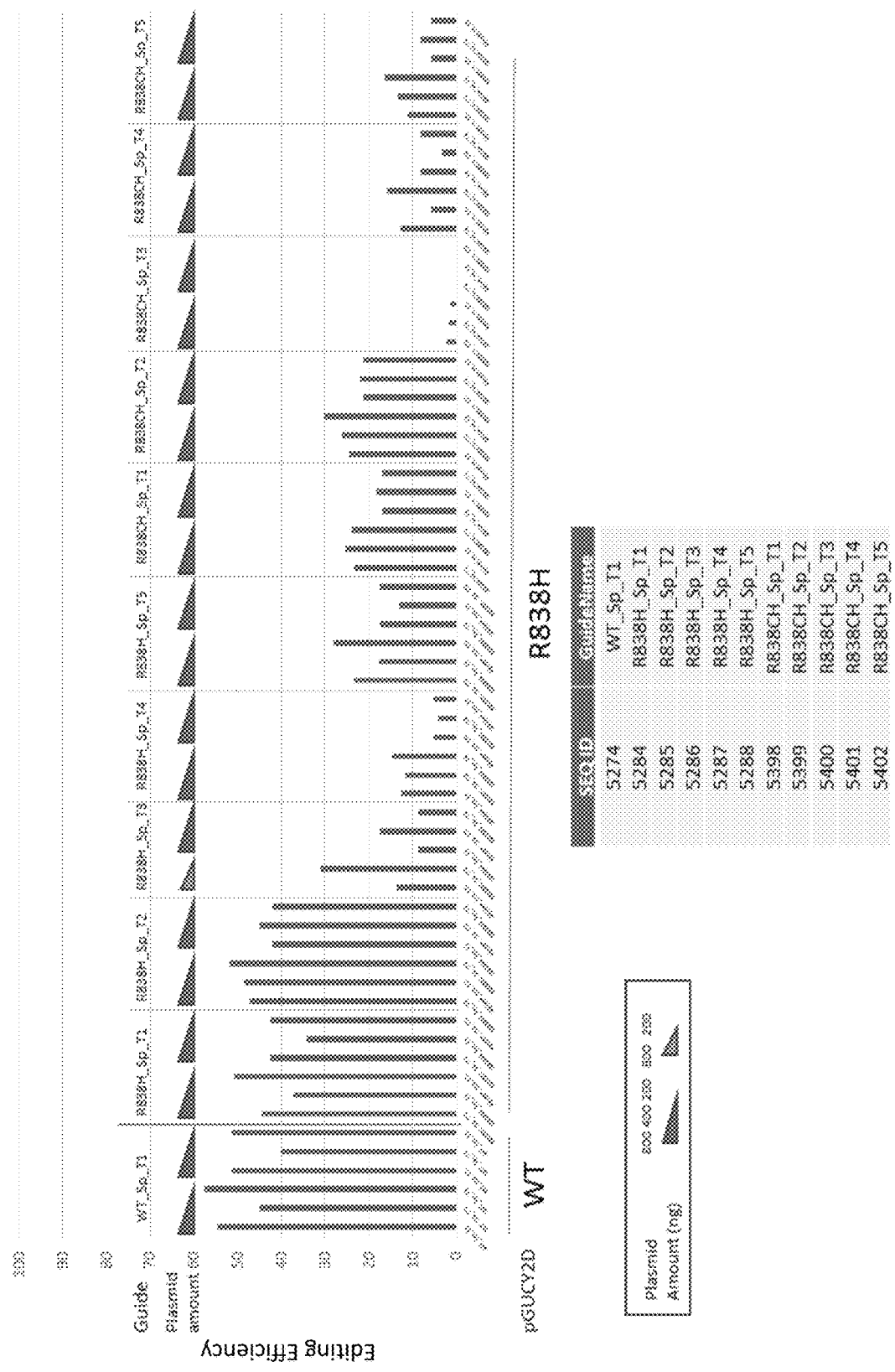
FIG. 5 describes the on-target editing efficiency of sgRNAs targeting the wild-type GUCY2D gene of a plasmid (a sgRNA comprising SEQ ID NO: 5274) and the on-target editing efficiency of sgRNAs targeting the R838H within the GUCY2D gene of a plasmid (sgRNAs comprising SEQ ID NO: 5284, 5285, 5286, 5287, 5288, 5398, 5399, 5400, 5401, or 5402).

Exemplary CRISPR/Cas polypeptides include the Cas9 polypeptides in FIG. 1 of Fonfara et al., *Nucleic Acids Research*, 42: 2577-2590 (2014). The CRISPR/Cas gene naming system has undergone extensive rewriting since the Cas genes were discovered. FIG. 5 of Fonfara, supra, provides PAM sequences for the Cas9 polypeptides from various species.

Site-Directed Polypeptides

A site-directed polypeptide is a nuclease used in genome editing to cleave DNA and/or induce site-directed mutagenesis. The site-directed nuclease can be administered to a cell or a patient as either: one or more polypeptides, or one or more mRNAs encoding the polypeptide. Any of the enzymes or orthologs listed in SEQ ID NOs. 1-612, or disclosed herein, can be utilized in the methods herein.

In the context of a CRISPR/Cas or CRISPR/Cpf1 system, the site-directed polypeptide can bind to a guide RNA that, in turn, specifies the site in the target DNA to which the polypeptide is directed. In the CRISPR/Cas or CRISPR/Cpf1 systems disclosed herein, the site-directed polypeptide can be an endonuclease, such as a DNA endonuclease.

A site-directed polypeptide can comprise a plurality of nucleic acid-cleaving (i.e., nuclease) domains. Two or more nucleic acid-cleaving domains can be linked together via a linker. For example, the linker can comprise a flexible linker. Linkers can comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the "Cas9" refers to both naturally occurring and recombinant Cas9s. Cas9 enzymes contemplated herein can comprise a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., a divalent cation binding site). RuvC/RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, e.g., genomic DNA. The double-strand break can stimulate a cell's endogenous DNA-repair pathways (e.g., HDR or NHEJ or ANHEJ or MMEJ). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template can comprise sequences that are homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligonucleotide, single-strand oligonucleotide or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ, in that small deletions and insertions can occur at the cleavage site. MMEJ can make use of homologous sequences of a few base pairs flanking the cleavage site to drive a favored end-joining DNA repair outcome. In some instances, it may be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous polynucleotide sequence is termed a donor polynucleotide (or donor or donor sequence) herein. The donor polynucleotide, a portion of the donor polynucleotide, a copy of the donor polynucleotide, or a portion of a copy of the donor polynucleotide can be inserted into the target nucleic acid cleavage site. The donor polynucleotide can be an exogenous polynucleotide sequence, i.e., a sequence that does not naturally occur at the target nucleic acid cleavage site.

The site-directed polypeptide can comprise an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to a wild-type exemplary site-directed polypeptide [e.g., Cas9 from *S. pyogenes*, US2014/0068797 Sequence ID No. 8 or Sapranauskas et al., *Nucleic Acids Res*, 39(21): 9275-9282 (2011)], and various other site-directed polypeptides. The site-directed polypeptide can comprise at least 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide.

The site-directed polypeptide can comprise a modified form of a wild-type exemplary site-directed polypeptide. The modified form of the wild-type exemplary site-directed polypeptide can comprise a mutation that reduces the nucleic acid-cleaving activity of the site-directed polypeptide. The modified form of the wild-type exemplary site-directed polypeptide can have less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes*, supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive."

The modified form of the site-directed polypeptide can comprise a mutation such that it can induce a SSB on a target nucleic acid (e.g., by cutting only one of the sugar-phosphate backbones of a double-strand target nucleic acid). The mutation can result in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes*, supra). The mutation can result in one or more of the plurality of nucleic acid-cleaving domains retaining the ability to cleave the complementary strand of the target nucleic acid, but reducing its ability to cleave the non-complementary strand of the target nucleic acid. The mutation can result in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary *S. pyogenes* Cas9 polypeptide, such as Asp10, His840, Asn854 and Asn856, are mutated to inactivate one or more of the plurality of nucleic acid-cleaving domains (e.g., nuclease domains). The residues to be mutated can correspond to residues Asp10, His840, Asn854 and Asn856 in the wild-type exemplary *S. pyogenes* Cas9 polypeptide (e.g., as determined by sequence and/or structural alignment). Non-limiting examples of mutations include D10A, H840A, N854A or N856A. Mutations other than alanine substitutions can be suitable.

A D10A mutation can be combined with one or more of H840A, N854A, or N856A mutations to produce a site-directed polypeptide substantially lacking DNA cleavage activity. A H840A mutation can be combined with one or more of D10A, N854A, or N856A mutations to produce a site-directed polypeptide substantially lacking DNA cleavage activity. A N854A mutation can be combined with one or more of H840A, D10A, or N856A mutations to produce a site-directed polypeptide substantially lacking DNA cleavage activity. A N856A mutation can be combined with one or more of H840A, N854A, or D10A mutations to produce a site-directed polypeptide substantially lacking DNA cleavage activity. Site-directed polypeptides that comprise one substantially inactive nuclease domain are referred to as "nickases".

Nickase variants of RNA-guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13 nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes.

Mutations contemplated can include substitutions, additions, and deletions, or any combination thereof. The mutation converts the mutated amino acid to alanine. The mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). The mutation converts the mutated amino acid to a non-natural amino acid (e.g., selenomethionine). The mutation converts the mutated amino acid to amino acid mimics (e.g., phosphomimics). The mutation can be a conservative mutation. For example, the mutation converts the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). The mutation can cause a shift in reading frame and/or the creation of a premature stop codon. Mutations can cause changes to regulatory regions of genes or loci that affect expression of one or more genes.

The site-directed polypeptide (e.g., variant, mutated, enzymatically inactive and/or conditionally enzymatically inactive site-directed polypeptide) can target nucleic acid. The site-directed polypeptide (e.g., variant, mutated, enzymatically inactive and/or conditionally enzymatically inactive endoribonuclease) can target DNA. The site-directed polypeptide (e.g., variant, mutated, enzymatically inactive and/or conditionally enzymatically inactive endoribonuclease) can target RNA.

The site-directed polypeptide can comprise one or more non-native sequences (e.g., the site-directed polypeptide is a fusion protein).

The site-directed polypeptide can comprise an amino acid sequence comprising at least 15% amino acid identity to a Cas9 from a bacterium (e.g., *S. pyogenes*), a nucleic acid binding domain, and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), and non-native sequence (for example, a nuclear localization signal) or a linker linking the site-directed polypeptide to a non-native sequence.

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain), wherein one of the nuclease domains comprises mutation of aspartic acid 10, and/or wherein one of the nuclease domains can comprise a mutation of histidine 840, and wherein the mutation reduces the cleaving activity of the nuclease domain(s) by at least 50%.

The one or more site-directed polypeptides, e.g. DNA endonucleases, can comprise two nickases that together effect one double-strand break at a specific locus in the genome, or four nickases that together effect or cause two double-strand breaks at specific loci in the genome. Alternatively, one site-directed polypeptide, e.g. DNA endonuclease, can effect or cause one double-strand break at a specific locus in the genome.

Non-limiting examples of Cas9 orthologs from other bacterial strains including but not limited to, Cas proteins identified in *Acaryochloris marina* MBIC11017; *Acetohalobium arabaticum* DSM 5501; *Acidithiobacillus caldus*; *Acidithiobacillus ferrooxidans* ATCC 23270; *Alicyclobacillus acidocaldarius* LAA1; *Alicyclobacillus acidocaldarius* subsp. *acidocaldarius* DSM 446; *Allochromatium vinosum* DSM 180; *Ammonifex degensii* KC4; *Anabaena variabilis* ATCC 29413; *Arthrospira maxima* CS-328; *Arthrospira platensis* str. Paraca; *Arthrospira* sp. PCC 8005; *Bacillus pseudomycoides* DSM 12442; *Bacillus selenitireducens* MLS10; *Burkholderiales bacterium* 1_1_47; *Caldicellulosiruptor becscii* DSM 6725; *Candidatus Desulforudis audaxviator* MP104C; *Caldicellulosiruptor hydrothermalis*_108; *Clostridium* phage c-st; *Clostridium botulinum* A3 str. Loch Maree; *Clostridium botulinum* Ba4 str. 657; *Clostridium difficile* QCD-63q42; *Crocosphaera watsonii* WH 8501; *Cyanothece* sp. ATCC 51142; *Cyanothece* sp. CCY0110; *Cyanothece* sp. PCC 7424; *Cyanothece* sp. PCC 7822; *Exiguobacterium sibiricum* 255-15; *Finegoldia magna* ATCC 29328; *Ktedonobacter racemifer* DSM 44963; *Lactobacillus delbrueckii* subsp. *bulgaricus* PB2003/044-T3-4; *Lactobacillus salivarius* ATCC 11741; *Listeria innocua*; *Lyngbya* sp. PCC 8106; *Marinobacter* sp. ELB17; *Methanohalobium evestigatum* Z-7303; *Microcystis* phage Ma-LMM01; *Microcystis aeruginosa* NIES-843; *Microscilla marina* ATCC 23134; *Microcoleus chthonoplastes* PCC 7420; *Neisseria meningitidis*; *Nitrosococcus halophilus* Nc4; *Nocardiopsis dassonvillei* subsp. *dassonvillei* DSM 43111; *Nodularia spumigena* CCY9414; *Nostoc* sp. PCC 7120; *Oscillatoria* sp. PCC 6506; *Pelotomaculum_thermopropionicum*_SI; *Petrotoga mobilis* SJ95; *Polaromonas naphthalenivorans* CJ2; *Polaromonas* sp. J5666; *Pseudoalteromonas haloplanktis* TAC125; *Streptomyces pristinaespiralis* ATCC 25486; *Streptomyces pristinaespiralis* ATCC 25486; *Streptococcus thermophilus*; *Streptomyces viridochromogenes* DSM 40736; *Streptosporangium roseum* DSM 43021; *Synechococcus* sp. PCC 7335; and *Thermosipho africanus* TCF52B (Chylinski et al., *RNA Biol.*, 2013; 10(5): 726-737.

In addition to Cas9 orthologs, other Cas9 variants such as fusion proteins of inactive dCas9 and effector domains with different functions can be served as a platform for genetic modulation. Any of the foregoing enzymes can be useful in the present disclosure.

Further examples of endonucleases that can be utilized in the present disclosure are provided in SEQ ID NOs: 1-612. These proteins can be modified before use or can be encoded in a nucleic acid sequence such as a DNA, RNA or mRNA or within a vector construct such as the plasmids or adeno-associated virus (AAV) vectors taught herein. Further, they can be codon optimized.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. The genome-targeting nucleic acid can be an RNA. A genome-targeting RNA is referred to as a "guide RNA" or "gRNA" herein. A guide RNA can comprise at least a spacer sequence that hybridizes to a target nucleic acid sequence of interest, and a CRISPR repeat sequence. In Type II systems, the gRNA also comprises a second RNA called the tracrRNA sequence. In the Type II gRNA, the CRISPR repeat sequence and tracrRNA sequence hybridize to each other to form a duplex. In the Type V gRNA, the crRNA forms a duplex. In both systems, the duplex can bind a site-directed polypeptide, such that the guide RNA and site-direct polypeptide form a complex. The genome-targeting nucleic acid can provide target specificity to the complex by virtue of its association with the site-directed polypeptide. The genome-targeting nucleic acid thus can direct the activity of the site-directed polypeptide.

Exemplary guide RNAs include the spacer sequences in SEQ ID NOs: 5272-5313, 5398-5409, and 5434-5443 of the Sequence Listing, shown with genome location of their target sequence (See SEQ ID NOs: 5314-5355 in FIG. 2B; 5410-5421 in FIG. 2E; and 5444-5453 in FIG. 2E) and the associated Cas9 cut site, wherein the genome location is based on the GRCh38/hg38 human genome assembly.

Each guide RNA can be designed to include a spacer sequence complementary to its genomic target sequence. For example, each of the spacer sequences in SEQ ID NOs: 5272-5313, 5398-5409, and 5434-5443 of the Sequence Listing can be put into a single RNA chimera or a crRNA (along with a corresponding tracrRNA). See Jinek et al., Science, 337, 816-821 (2012) and Deltcheva et al., Nature, 471, 602-607 (2011).

The genome-targeting nucleic acid can be a double-molecule guide RNA. The genome-targeting nucleic acid can be a single-molecule guide RNA. The double-molecule guide RNA or single-molecule guide RNA can be modified.

A double-molecule guide RNA can comprise two strands of RNA. The first strand comprises in the 5' to 3' direction, an optional spacer extension sequence, a spacer sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

The sgRNA can comprise a variable length spacer sequence with 17-30 nucleotides at the 5' end of the sgRNA sequence (Table 4). In other examples, the sgRNA can comprise a variable length spacer sequence with 17-24 nucleotides at the 5' end of the sgRNA sequence.

The sgRNA can comprise a 20 nucleotide spacer sequence at the 5' end of the sgRNA sequence. The sgRNA can comprise a less than 20 nucleotide spacer sequence at the 5' end of the sgRNA sequence. The sgRNA can comprise a 19 nucleotide spacer sequence at the 5' end of the sgRNA sequence. The sgRNA can comprise a 18 nucleotide spacer sequence at the 5' end of the sgRNA sequence. The sgRNA can comprise a 17 nucleotide spacer sequence at the 5' end of the sgRNA sequence. The sgRNA can comprise a more than 20 nucleotide spacer sequence at the 5' end of the sgRNA sequence. The sgRNA can comprise a 21 nucleotide spacer sequence at the 5' end of the sgRNA sequence. The sgRNA can comprise a 22 nucleotide spacer sequence at the 5' end of the sgRNA sequence. The sgRNA can comprise a 23 nucleotide spacer sequence at the 5' end of the sgRNA sequence. The sgRNA can comprise a 24 nucleotide spacer sequence at the 5' end of the sgRNA sequence. The sgRNA can comprise a 25 nucleotide spacer sequence at the 5' end of the sgRNA sequence. The sgRNA can comprise a 26 nucleotide spacer sequence at the 5' end of the sgRNA sequence. The sgRNA can comprise a 27 nucleotide spacer sequence at the 5' end of the sgRNA sequence. The sgRNA can comprise a 28 nucleotide spacer sequence at the 5' end of the sgRNA sequence. The sgRNA can comprise a 29 nucleotide spacer sequence at the 5' end of the sgRNA sequence. The sgRNA can comprise a 30 nucleotide spacer sequence at the 5' end of the sgRNA sequence.

The sgRNA can comprise no uracil at the 3'end of the sgRNA sequence, such as in SEQ ID NOs: 5268, 5495, 5498, 5501, and 5504 of Table 4. The sgRNA can comprise one or more uracil at the 3'end of the sgRNA sequence, such as in SEQ ID NO: 5269, 5267, 5494, 5496, 5497, 5499, 5500, 5502, 5503, and 5505 in Table 4. For example, the sgRNA can comprise 1 uracil (U) at the 3' end of the sgRNA sequence. The sgRNA can comprise 2 uracil (UU) at the 3' end of the sgRNA sequence. The sgRNA can comprise 3 uracil (UUU) at the 3' end of the sgRNA sequence. The sgRNA can comprise 4 uracil (UUUU) at the 3' end of the sgRNA sequence. The sgRNA can comprise 5 uracil (UUUUU) at the 3' end of the sgRNA sequence. The sgRNA can comprise 6 uracil (UUUUUU) at the 3' end of the sgRNA sequence. The sgRNA can comprise 7 uracil (UUUUUUU) at the 3' end of the sgRNA sequence. The sgRNA can comprise 8 uracil (UUUUUUUU) at the 3' end of the sgRNA sequence.

The sgRNA can be unmodified or modified. For example, modified sgRNAs can comprise one or more 2'-O-methyl phosphorothioate nucleotides.

TABLE 4

| SEQ ID NO. | sgRNA sequence | |
|---|---|---|
| 5267 | $n_{(17-30)}$guuuuagagcuagaaauagcaaguuaaaauaaggc uaguccguuaucaacuugaaaaaguggcaccgagucggug cuuuu | Sp |
| 5268 | $n_{(17-30)}$guuuuagagcuagaaauagcaaguuaaaauaaggc uaguccguuaucaacuugaaaaaguggcaccgagucggugc | Sp |
| 5269 | $n_{(17-30)}$guuuuagagcuagaaauagcaaguuaaaauaaggc uaguccguuaucaacuugaaaaaguggcaccgagucggug $cu_{(1-8)}$ | Sp |
| 5494 | $n_{(17-30)}$guuuaaguacucugugcuggaaacagcacagaauc uacuuaaacaaggcaaaaugccguguuuaucucgucaacu uguuggcgagauuuuuuu | Sa |
| 5495 | $n_{(17-30)}$guuuaaguacucugugcuggaaacagcacagaauc uacuuaaacaaggcaaaaugccguguuuaucucgucaacu uguuggcgaga | Sa |
| 5496 | $n_{(17-30)}$guuuaaguacucugugcuggaaacagcacagaauc uacuuaaacaaggcaaaaugccguguuuaucucgucaacu $uguuggcgagau_{(1-8)}$ | Sa |
| 5497 | $n_{(17-30)}$guuuuaguacucuguaaugaaaauuacagaaucua cuaaaacaaggcaaaaugccguguuuaucucgucaacuug uuggcgagauuuuuuu | Sa |
| 5498 | $n_{(17-30)}$guuuuaguacucuguaaugaaaauuacagaaucua cuaaaacaaggcaaaaugccguguuuaucucgucaacuug uuggcgaga | Sa |
| 5499 | $n_{(17-30)}$guuuuaguacucuguaaugaaaauuacagaaucua cuaaaacaaggcaaaaugccguguuuaucucgucaacuug $uuggcgagau_{(1-8)}$ | Sa |
| 5500 | $n_{(17-30)}$guuuaaguacucugugcuggaaacagcacagaauc uacuuaaacaaggcaaaaugccguguuuaucucgucaacu uguuggcgagauuuuuuu | Sa |
| 5501 | $n_{(17-30)}$guuuaaguacucugugcuggaaacagcacagaauc uacuuaaacaaggcaaaaugccguguuuaucucgucaacu uguuggcgaga | Sa |

TABLE 4 -continued

| SEQ ID NO. | sgRNA sequence | |
|---|---|---|
| 5502 | $n_{(17-30)}$guuuaaguacucugugcuggaaacagcacagaauc uacuuaaacaaggcaaaaugccguguuuaucucgucaacu $uguuggcgagau_{(1-8)}$ | Sa |
| 5503 | $n_{(17-30)}$guuuuaguacucuggaaacagaaucuacuaaaaca aggcaaaaugccguguuuaucucgucaacuuguuggcgag auuuu | Sa |
| 5504 | $n_{(17-30)}$guuuuaguacucuggaaacagaaucuacuaaaaca aggcaaaaugccguguuuaucucgucaacuuguuggcgaga | Sa |
| 5505 | $n_{(17-30)}$guuuuaguacucuggaaacagaaucuacuaaaaca aggcaaaaugccguguuuaucucgucaacuuguuggcgag $au_{(1-8)}$ | Sa |

A single-molecule guide RNA (sgRNA) in a Type V system can comprise, in the 5' to 3' direction, a minimum CRISPR repeat sequence and a spacer sequence.

By way of illustration, guide RNAs used in the CRISPR/Cas/Cpf1 system, or other smaller RNAs, can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

gRNAs or sgRNAs that Target the R838H Mutation in a GUCY2D Gene

The present disclosure provides one or more gRNAs (or sgRNAs) for editing a R838H mutation in a GUCY2D gene in a cell from a patient with autosomal dominant CORD (FIGS. 2A and 2D).

The one or more gRNAs can comprise a spacer sequence selected from the group consisting of nucleic acid sequences in SEQ ID NOs: 5282-5293 of the Sequence Listing. These gRNA sequences have zero mismatches with the R838H GUCY2D allele and 1 mismatch with the wild-type GUCY2D allele.

The one or more gRNAs can comprise a spacer sequence selected from the group consisting of nucleic acid sequences in SEQ ID NOs: 5398-5409 of the Sequence Listing. These gRNA sequences have 1 mismatch with the R838H GUCY2D allele and 2 mismatches with the wild-type GUCY2D allele.

gRNAs or sgRNAs disclosed herein can associate with a DNA endonuclease to form a ribonucleoprotein complex, which stably edits the R838H mutation in a GUCY2D gene. This editing is not transient.

gRNAs or sgRNAs that Target the R838C Mutation in a GUCY2D Gene

The present disclosure provides one or more gRNAs (or sgRNAs) for editing a R838C mutation in a GUCY2D gene in a cell from a patient with autosomal dominant CORD (FIGS. 2A and 2D).

The one or more gRNAs can comprise a spacer sequence selected from the group consisting of nucleic acid sequences in SEQ ID NOs: 5294-5303 of the Sequence Listing. These gRNA sequences have zero mismatches with the R838C GUCY2D allele and 1 mismatch with the wild-type GUCY2D allele.

The one or more gRNAs can comprise a spacer sequence selected from the group consisting of nucleic acid sequences in 5398-5409 of the Sequence Listing. These gRNA sequences have 1 mismatch with the R838C GUCY2D allele and 2 mismatches with the wild-type GUCY2D allele.

gRNAs or sgRNAs disclosed herein can associate with a DNA endonuclease to form a ribonucleoprotein complex, which stably edits the R838C mutation in a GUCY2D gene. This editing is not transient.

gRNAs or sgRNAs that Target the R838S Mutation in a GUCY2D Gene

The present disclosure provides one or more gRNAs (or sgRNAs) for editing a R838S mutation in a GUCY2D gene in a cell from a patient with autosomal dominant CORD (FIGS. 2A and 2D).

The one or more gRNAs can comprise a spacer sequence selected from the group consisting of nucleic acid sequences in SEQ ID NOs: 5304-5313 of the Sequence Listing. These gRNA sequences have zero mismatches with the R838S GUCY2D allele and 1 mismatch with the wild-type GUCY2D allele.

The one or more gRNAs can comprise a spacer sequence selected from the group consisting of nucleic acid sequences in 5434-5443 of the Sequence Listing. These gRNA sequences have 1 mismatch with the R838S GUCY2D allele and 2 mismatches with the wild-type GUCY2D allele.

gRNAs or sgRNAs disclosed herein can associate with a DNA endonuclease to form a ribonucleoprotein complex, which stably edits the R838S mutation in a GUCY2D gene. This editing is not transient.

"Double Mutation" Guide RNAs

The present disclosure provides gRNAs (or sgRNAs), referred to herein as, "double mutation" guide RNAs, that can edit multiple mutant alleles of the GUCY2D gene.

In certain examples, the double mutation guide RNAs can comprise a spacer sequence comprising 1 mismatched base with, for example, an R838C mutant allele and comprising a second mismatched base with, for example, a R838H mutant allele. Double mutation gRNAs that target the R838C and R838H mutant alleles are referred to herein as "R838CH double mutation" gRNAs.

In certain other examples, the double mutation guide RNAs can comprise a spacer sequence comprising 1 mismatched base with, for example, an R838S mutant allele and comprising a second mismatched based with, for example a R838H mutant allele. Double mutation gRNAs that target the R838S and R838H mutant alleles are referred to herein as "R838SH double mutation" gRNAs.

The double mutation guide RNAs (e.g., R838CH double mutation gRNAs or R838SH double mutation gRNAs) can comprise 2 mismatched bases with a wild-type allele. The double mutation guide RNAs can comprise reduced off-target editing of a wild-type GUCY2D allele.

gRNAs or sgRNAs that Target the R838C and R838H Mutations in a GUCY2D Gene (R838CH Double Mutation gRNAs)

The present disclosure provides gRNAs (or sgRNAs) for editing a R838C or R838H mutation in a GUCY2D gene in a cell from a patient with autosomal dominant CORD (FIG. 2D).

The gRNAs can comprise a spacer sequence selected from the group consisting of nucleic acid sequences in SEQ ID NOs: 5398-5409 of the Sequence Listing. These gRNA sequences have 1 mismatch with the R838C GUCY2D allele and R838H GUCY2D allele. These gRNA sequences have 2 mismatches with the wild-type GUCY2D allele.

These gRNAs can be used to treat patients with a R838H mutation in the GUCY2D gene or patients with an R838C mutation in the GUCY2D gene. These gRNAs can be specific for both the R838H and R838C mutant allele because they have two consecutive mismatches compared to a sequence that corresponds with the wild-type codon 838. The two consecutive mismatches in the gRNA sequence reduce the probability that the wild-type GUCY2D sequence will be cleaved because the two mismatches within the gRNA are consecutive and not separated (FIG. 3 of Klein et al "Hybridization Kinetics Explains CRISPR-Cas Off-Targeting Rules", Cell Reports 22, February 2018, pages 1413-1423).

gRNAs or sgRNAs disclosed herein can associate with a DNA endonuclease to form a ribonucleoprotein complex, which stably edits either the R838C mutation or R838H mutation in a GUCY2D gene. This editing is not transient.

gRNAs or sgRNAs that Target the R838S and R838H Mutations in a GUCY2D Gene (R838SH Double Mutation gRNAs)

The present disclosure provides gRNAs (or sgRNAs) for editing a R838S or R838H mutation in a GUCY2D gene in a cell from a patient with autosomal dominant CORD (FIG. 2D).

The gRNAs can comprise a spacer sequence selected from the group consisting of nucleic acid sequences in SEQ ID NOs: 5434-5443 of the Sequence Listing. These gRNA sequences have 1 mismatch with the R838S GUCY2D allele and R838H GUCY2D allele. These gRNA sequences have 2 mismatches with the wild-type GUCY2D allele.

These gRNAs can be used to treat patients with a R838S mutation in the GUCY2D gene or patients with an R838H mutation in the GUCY2D gene. These gRNAs can be specific for both the R838S and R838H mutant allele because they have two consecutive mismatches compared to a sequence that corresponds with the wild-type codon 838. As described above, the two consecutive mismatches reduce the probability that the wild-type GUCY2D sequence will be cleaved because the two mismatches within the gRNA are consecutive and not separated.

gRNAs or sgRNAs disclosed herein can associate with a DNA endonuclease to form a ribonucleoprotein complex, which stably edits either the R838S mutation or R838H mutation in a GUCY2D gene. This editing is not transient.

Spacer Extension Sequence

In some examples of genome-targeting nucleic acids, a spacer extension sequence can modify activity, provide stability and/or provide a location for modifications of a genome-targeting nucleic acid. A spacer extension sequence can modify on- or off-target activity or specificity. In some examples, a spacer extension sequence can be provided. The spacer extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. The spacer extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. The spacer extension sequence can be less than 10 nucleotides in length. The spacer extension sequence can be between 10-30 nucleotides in length. The spacer extension sequence can be between 30-70 nucleotides in length.

The spacer extension sequence can comprise another moiety (e.g., a stability control sequence, an endoribonuclease binding sequence, a ribozyme). The moiety can decrease or increase the stability of a nucleic acid targeting nucleic acid. The moiety can be a transcriptional terminator segment (i.e., a transcription termination sequence). The moiety can function in a eukaryotic cell. The moiety can function in a prokaryotic cell. The moiety can function in both eukaryotic and prokaryotic cells. Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a genome-targeting nucleic acid can interact with a target nucleic acid in a sequence-specific manner via hybridization (i.e., base pairing). The nucleotide sequence of the spacer can vary depending on the sequence of the target nucleic acid of interest. In a CRISPR/Cas system herein, the spacer sequence can be designed to hybridize to a target nucleic acid that is located 5' of a PAM of the Cas9 or Cpf1 enzyme used in the system. The spacer can perfectly match the target sequence or can have mismatches. Each Cas9 enzyme has a particular PAM sequence that it recognizes in a target DNA. For example, S. pyogenes recognizes in a target nucleic acid a PAM that comprises the sequence 5'-NRG-3', where R comprises either A or G, where N is any nucleotide and N is immediately 3' of the target nucleic acid sequence targeted by the spacer sequence. For example, S. aureus Cas9 recognizes in a target nucleic acid a PAM that comprises the sequence 5'-NNGRRT-3', where R comprises either A or G, where N is any nucleotide and N is immediately 3' of the target nucleic acid sequence targeted by the spacer sequence. In certain examples, S. aureus Cas9 recognizes in a target nucleic acid a PAM that comprises the sequence 5'-NNGRRN-3', where R comprises either A or G, where N is any nucleotide and the N is immediately 3' of the target nucleic acid sequence targeted by the spacer sequence. For example, C. jejuni recognizes in a target nucleic acid a PAM that comprises the sequence 5'-NNNNACA-3' or 5'-NNNNACAC-3', where N is any nucleotide and N is immediately 3' of the target nucleic acid sequence targeted by the spacer sequence. In certain examples, C. jejuni Cas9 recognizes in a target nucleic acid a PAM that comprises the sequence 5'-NNNVRYM-3' or 5'-NNVRYAC-3', where V comprises either A, G or C, where R comprises either A or G, where Y comprises either C or T, where M comprises A or C, where N is any nucleotide and the N is immediately 3' of the target nucleic acid sequence targeted by the spacer sequence.

The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. The target nucleic acid can comprise at most: 5, 10, 15, 16, 17, 18, 19, 20, 21, 22, 23, 24, 25, 30 or more nucleotides. The target nucleic acid sequence can comprise 20 bases immediately 5' of the first nucleotide of the PAM. For example, in a sequence comprising 5'-NNNNNNNNNNNNNNNNNNNNNRG-3' (SEQ ID NO. 5270), the target nucleic acid can comprise the sequence that corresponds to the Ns, wherein N is any nucleotide, and the underlined NRG sequence is the S. pyogenes PAM.

The spacer sequence that hybridizes to the target nucleic acid can have a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some examples, the spacer can comprise 24 nucleotides. In some examples, the spacer can comprise 23 nucleotides. In some examples, the spacer can comprise 22 nucleotides. In some examples, the spacer can comprise 21 nucleotides. In some examples, the spacer sequence can comprise 20 nucleotides. In some examples, the spacer can comprise 19 nucleotides. In some examples, the spacer can comprise 18 nucleotides. In some examples, the spacer can comprise 17 nucleotides.

In some examples, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the spacer sequence and the target nucleic acid is 100% over the six contiguous 5'-most nucleotides of the target sequence of the complementary strand of the target nucleic acid. The percent complementarity between the spacer sequence and the target nucleic acid can be at least 60% over about 20 contiguous nucleotides. The length of the spacer sequence and the target nucleic acid can differ by 1 to 6 nucleotides, which can be thought of as a bulge or bulges.

The spacer sequence can be designed or chosen using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

A minimum CRISPR repeat sequence can be a sequence with at least about 30%, about 40%, about 50%, about 60%, about 65%, about 70%, about 75%, about 80%, about 85%, about 90%, about 95%, or 100% sequence identity to a reference CRISPR repeat sequence (e.g., crRNA from *S. pyogenes*).

A minimum CRISPR repeat sequence can comprise nucleotides that can hybridize to a minimum tracrRNA sequence in a cell. The minimum CRISPR repeat sequence and a minimum tracrRNA sequence can form a duplex, i.e. a base-paired double-stranded structure. Together, the minimum CRISPR repeat sequence and the minimum tracrRNA sequence can bind to the site-directed polypeptide. At least a part of the minimum CRISPR repeat sequence can hybridize to the minimum tracrRNA sequence. At least a part of the minimum CRISPR repeat sequence can comprise at least about 30%, about 40%, about 50%, about 60%, about 65%, about 70%, about 75%, about 80%, about 85%, about 90%, about 95%, or 100% complementary to the minimum tracrRNA sequence. At least a part of the minimum CRISPR repeat sequence can comprise at most about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some examples, the minimum CRISPR repeat sequence can be approximately 9 nucleotides in length. The minimum CRISPR repeat sequence can be approximately 12 nucleotides in length.

The minimum CRISPR repeat sequence can be at least about 60% identical to a reference minimum CRISPR repeat sequence (e.g., wild-type crRNA from *S. pyogenes*) over a stretch of at least 6, 7, or 8 contiguous nucleotides. For example, the minimum CRISPR repeat sequence can be at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

A minimum tracrRNA sequence can be a sequence with at least about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from *S. pyogenes*).

A minimum tracrRNA sequence can comprise nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat can bind to a site-directed polypeptide. At least a part of the minimum tracrRNA sequence can hybridize to the minimum CRISPR repeat sequence. The minimum tracrRNA sequence can be at least about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. The minimum tracrRNA sequence can be approximately 9 nucleotides in length. The minimum tracrRNA sequence can be approximately 12 nucleotides. The minimum tracrRNA can consist of tracrRNA nt 23-48 described in Jinek et al., supra.

The minimum tracrRNA sequence can be at least about 60% identical to a reference minimum tracrRNA (e.g., wild type, tracrRNA from *S. pyogenes*) sequence over a stretch of at least 6, 7, or 8 contiguous nucleotides. For example, the minimum tracrRNA sequence can be at least about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least 6, 7, or 8 contiguous nucleotides.

The duplex between the minimum CRISPR RNA and the minimum tracrRNA can comprise a double helix. The duplex between the minimum CRISPR RNA and the minimum tracrRNA can comprise at least about 1, 2, 3, 4, 5, 6, 7, 8, 9, or 10 or more nucleotides. The duplex between the minimum CRISPR RNA and the minimum tracrRNA can comprise at most about 1, 2, 3, 4, 5, 6, 7, 8, 9, or 10 or more nucleotides.

The duplex can comprise a mismatch (i.e., the two strands of the duplex are not 100% complementary). The duplex can comprise at least about 1, 2, 3, 4, or 5 or mismatches. The duplex can comprise at most about 1, 2, 3, 4, or 5 or mismatches. The duplex can comprise no more than 2 mismatches.

Bulges

In some cases, there can be a "bulge" in the duplex between the minimum CRISPR RNA and the minimum tracrRNA. A bulge is an unpaired region of nucleotides within the duplex. A bulge can contribute to the binding of the duplex to the site-directed polypeptide. The bulge can comprise, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge can comprise an unpaired purine (e.g., adenine) on the minimum CRISPR repeat strand of the bulge. In some examples, the bulge can comprise an unpaired 5'-AAGY-3' of the minimum tracrRNA sequence strand of the bulge, where Y comprises a nucleotide that can form a wobble pairing with a nucleotide on the minimum CRISPR repeat strand.

A bulge on the minimum CRISPR repeat side of the duplex can comprise at least 1, 2, 3, 4, or 5 or more unpaired nucleotides. A bulge on the minimum CRISPR repeat side of the duplex can comprise at most 1, 2, 3, 4, or 5 or more unpaired nucleotides. A bulge on the minimum CRISPR repeat side of the duplex can comprise 1 unpaired nucleotide.

A bulge on the minimum tracrRNA sequence side of the duplex can comprise at least 1, 2, 3, 4, 5, 6, 7, 8, 9, or 10 or more unpaired nucleotides. A bulge on the minimum tracrRNA sequence side of the duplex can comprise at most 1, 2, 3, 4, 5, 6, 7, 8, 9, or 10 or more unpaired nucleotides. A bulge on a second side of the duplex (e.g., the minimum tracrRNA sequence side of the duplex) can comprise 4 unpaired nucleotides.

A bulge can comprise at least one wobble pairing. In some examples, a bulge can comprise at most one wobble pairing. A bulge can comprise at least one purine nucleotide. A bulge can comprise at least 3 purine nucleotides. A bulge sequence can comprise at least 5 purine nucleotides. A bulge sequence can comprise at least one guanine nucleotide. In some examples, a bulge sequence can comprise at least one adenine nucleotide.

Hairpins

In various examples, one or more hairpins can be located 3' to the minimum tracrRNA in the 3' tracrRNA sequence.

The hairpin can start at least about 1, 2, 3, 4, 5, 6, 7, 8, 9, 10, 15, or 20 or more nucleotides 3' from the last paired nucleotide in the minimum CRISPR repeat and minimum tracrRNA sequence duplex. The hairpin can start at most about 1, 2, 3, 4, 5, 6, 7, 8, 9 or 10 or more nucleotides 3' of the last paired nucleotide in the minimum CRISPR repeat and minimum tracrRNA sequence duplex.

The hairpin can comprise at least about 1, 2, 3, 4, 5, 6, 7, 8, 9, 10, 15, or 20 or more consecutive nucleotides. The hairpin can comprise at most about 1, 2, 3, 4, 5, 6, 7, 8, 9, 10, 15, or more consecutive nucleotides.

The hairpin can comprise a CC dinucleotide (i.e., two consecutive cytosine nucleotides).

The hairpin can comprise duplexed nucleotides (e.g., nucleotides in a hairpin, hybridized together). For example, a hairpin can comprise a CC dinucleotide that is hybridized to a GG dinucleotide in a hairpin duplex of the 3' tracrRNA sequence.

One or more of the hairpins can interact with guide RNA-interacting regions of a site-directed polypeptide.

In some examples, there are two or more hairpins, and in other examples there are three or more hairpins.

3' tracrRNA Sequence

A 3' tracrRNA sequence can comprise a sequence with at least about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from *S. pyogenes*).

The 3' tracrRNA sequence can have a length from about 6 nucleotides to about 100 nucleotides. For example, the 3' tracrRNA sequence can have a length from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. The 3' tracrRNA sequence can have a length of approximately 14 nucleotides.

The 3' tracrRNA sequence can be at least about 60% identical to a reference 3' tracrRNA sequence (e.g., wild type 3' tracrRNA sequence from *S. pyogenes*) over a stretch of at least 6, 7, or 8 contiguous nucleotides. For example, the 3' tracrRNA sequence can be at least about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from *S. pyogenes*) over a stretch of at least 6, 7, or 8 contiguous nucleotides.

The 3' tracrRNA sequence can comprise more than one duplexed region (e.g., hairpin, hybridized region). The 3' tracrRNA sequence can comprise two duplexed regions.

The 3' tracrRNA sequence can comprise a stem loop structure. The stem loop structure in the 3' tracrRNA can comprise at least 1, 2, 3, 4, 5, 6, 7, 8, 9, 10, 15 or 20 or more nucleotides. The stem loop structure in the 3' tracrRNA can comprise at most 1, 2, 3, 4, 5, 6, 7, 8, 9 or 10 or more nucleotides. The stem loop structure can comprise a functional moiety. For example, the stem loop structure can comprise an aptamer, a ribozyme, a protein-interacting hairpin, a CRISPR array, an intron, or an exon. The stem loop structure can comprise at least about 1, 2, 3, 4, or 5 or more functional moieties. The stem loop structure can comprise at most about 1, 2, 3, 4, or 5 or more functional moieties.

The hairpin in the 3' tracrRNA sequence can comprise a P-domain. In some examples, the P-domain can comprise a double-stranded region in the hairpin.

tracrRNA Extension Sequence

A tracrRNA extension sequence can be provided whether the tracrRNA is in the context of single-molecule guides or double-molecule guides. The tracrRNA extension sequence can have a length from about 1 nucleotide to about 400 nucleotides. The tracrRNA extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. The tracrRNA extension sequence can have a length from about 20 to about 5000 or more nucleotides. The tracrRNA extension sequence can have a length of more than 1000 nucleotides. The tracrRNA extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. The tracrRNA extension sequence can have a length of less than 1000 nucleotides. The tracrRNA extension sequence can comprise less than 10 nucleotides in length. The tracrRNA extension sequence can be 10-30 nucleotides in length. The tracrRNA extension sequence can be 30-70 nucleotides in length.

The tracrRNA extension sequence can comprise a functional moiety (e.g., a stability control sequence, ribozyme, endoribonuclease binding sequence). The functional moiety can comprise a transcriptional terminator segment (i.e., a transcription termination sequence). The functional moiety can have a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 15 nt to about 50 nt, from about 15 nt to about 40 nt, from about 15 nt to about 30 nt, or from about 15 nt to about 25 nt. The functional moiety can function in a eukaryotic cell. The functional moiety can function in a prokaryotic cell. The functional moiety can function in both eukaryotic and prokaryotic cells.

Non-limiting examples of suitable tracrRNA extension functional moieties include a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). The tracrRNA extension sequence can comprise a primer binding site or a molecular index (e.g., barcode sequence). The tracrRNA extension sequence can comprise one or more affinity tags.

Single-Molecule Guide Linker Sequence

The linker sequence of a single-molecule guide nucleic acid can have a length from about 3 nucleotides to about 100 nucleotides. In Jinek et al., supra, for example, a simple 4 nucleotide "tetraloop" (-GAAA-) was used, Science, 337 (6096):816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. The linker of a single-molecule guide nucleic acid can be between 4 and 40 nucleotides. The linker can be at least about 100, 500, 1000, 1500, 2000, 2500, 3000, 3500, 4000, 4500, 5000, 5500, 6000, 6500, or 7000 or more nucleotides. The linker can be at most about 100, 500, 1000, 1500, 2000, 2500, 3000, 3500, 4000, 4500, 5000, 5500, 6000, 6500, or 7000 or more nucleotides.

Linkers can comprise any of a variety of sequences, although in some examples the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337 (6096):816-821 (2012), but numerous other sequences, including longer sequences can likewise be used.

The linker sequence can comprise a functional moiety. For example, the linker sequence can comprise one or more features, including an aptamer, a ribozyme, a protein-interacting hairpin, a protein binding site, a CRISPR array, an intron, or an exon. The linker sequence can comprise at least about 1, 2, 3, 4, or 5 or more functional moieties. In some examples, the linker sequence can comprise at most about 1, 2, 3, 4, or 5 or more functional moieties.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

Ribonucleoprotein Complexes (RNPs)

The site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The site-directed polypeptide can be pre-complexed with one or more sgRNA. The pre-complexed material can then be administered to a cell or a patient. Such pre-complexed material is known as a ribonucleoprotein particle (RNP). The site-directed polypeptide in the RNP can be, for example, a Cas9 endonuclease or a Cpf1 endonuclease. The site-directed polypeptide can be flanked at the N-terminus, the C-terminus, or both the N-terminus and C-terminus by one or more nuclear localization signals (NLSs). For example, a Cas9 endonuclease can be flanked by two NLSs, one NLS located at the N-terminus and the second NLS located at the C-terminus. The NLS can be any NLS known in the art, such as a SV40 NLS. The weight ratio of genome-targeting nucleic acid to site-directed polypeptide in the RNP can be 1:1. For example, the weight ratio of sgRNA to Cas9 endonuclease in the RNP can be 1:1.

Target Sequence Selection

Shifts in the location of the 5' boundary and/or the 3' boundary relative to particular reference loci can be used to facilitate or enhance particular applications of gene editing, which depend in part on the endonuclease system selected for the editing, as further described and illustrated herein.

In a first non-limiting example of such target sequence selection, many endonuclease systems have rules or criteria that can guide the initial selection of potential target sites for cleavage, such as the requirement of a PAM sequence motif in a particular position adjacent to the DNA cleavage sites in the case of CRISPR Type II or Type V endonucleases.

In another nonlimiting example of target sequence selection or optimization, the frequency of off-target activity for a particular combination of target sequence and gene editing endonuclease can be assessed relative to the frequency of on-target activity. In some cases, cells that have been correctly edited at the desired locus can have a selective advantage relative to other cells. Illustrative, but nonlimiting, examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus can be positively selected for by one or more screening methods used to identify, sort or otherwise select for cells that have been correctly edited. Both selective advantage and directed selection methods can take advantage of the phenotype associated with the correction. In some cases, cells can be edited two or more times in order to create a second modification that creates a new phenotype that is used to select or purify the intended population of cells. Such a second modification could be created by adding a second gRNA for a selectable or screenable marker. In some cases, cells can be correctly edited at the desired locus using a DNA fragment that contains the cDNA and also a selectable marker.

Whether any selective advantage is applicable or any directed selection is to be applied in a particular case, target sequence selection can also be guided by consideration of off-target frequencies in order to enhance the effectiveness of the application and/or reduce the potential for undesired alterations at sites other than the desired target. As described further and illustrated herein and in the art, the occurrence of off-target activity can be influenced by a number of factors including similarities and dissimilarities between the target site and various off-target sites, as well as the particular endonuclease used. Bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

gRNAs of the present disclosure can direct editing at a genetic locus where editing is desired (e.g., a mutant allele of the GUCY2D gene). As used herein, "on-target editing," "on-target activity," or "on-target cleavage" means editing at a genetic locus where editing is desired. A R838S gRNA, a R838C gRNA, a R838H gRNA, a double mutation R838CH gRNA, or a double mutation R838SH gRNA has on-target activity when the gRNA directs editing of the corresponding mutant allele (or mutant alleles in the case of double mutation gRNAs) at or near the R838 position.

gRNAs of the present disclosure can also direct editing at a genetic locus where editing is not desired. As used herein, "off-target editing," "off-target activity," or "off-target cleavage" means editing at a genetic locus where editing is not desired.

Off-target editing can be editing of a wild-type allele of the GUCY2D gene. Herein, this type of off-target editing is termed "wild-type off-target editing," "wild-type off-target activity," or "wild-type off-target cleavage." A R838S gRNA, a R838C gRNA, a R838H gRNA, a double mutation R838CH gRNA, or a double mutation R838SH gRNA can have wild-type off-target activity when the gRNA directs editing of a wild-type GUCY2D allele.

Off-target editing can be editing of a second gene or locus (e.g., editing of a genomic sequence that is not a sequence of the GUCY2D gene or a regulatory sequence of the GUCY2D gene). Herein, this type of off-target editing is termed "genomic off-target editing," "genomic off-target activity," or "genomic off-target cleavage." A R838S gRNA, a R838C gRNA, a R838H gRNA, a double mutation R838CH gRNA, or a double mutation R838SH gRNA has genomic off-target activity when the gRNA directs editing of a genomic sequence that is not a sequence of the GUCY2D gene or a regulatory sequence of the GUCY2D gene.

In some examples, wild-type off-target activity of a gRNA can be "minimal." gRNAs with minimal wild-type off-target activity can be determined using methods known in the art, for example, methods based on in silico analysis, in vitro methods, or in vivo methods of determining the amount of wild-type off-target editing caused by a gRNA. A gRNA with minimal wild-type off-target activity can cause off-target editing in 30% or less of cells, for example, 25% or less of cells, 20% or less of cells, 15% or less of cells 10% or less of cells, 5% or less of cells, 4% or less of cells, 3% or less of cells, 2% or less of cells, 1% or less of cells, 0.5% or less of cells, 0.25% or less of cells, or 0.1% or less of cells. Such determinations can, in some cases, be determined using in vitro systems.

In some examples, genomic off-target activity of a gRNA can be "minimal." gRNAs with minimal genomic off-target activity can be determined based on in silico analysis, in vitro methods, or in vivo methods of determining the amount of genomic off-target editing caused by a gRNA. A gRNA with minimal genomic off-target activity can cause at least one instance of genomic off-target editing in 30% or less of cells such as, for example, 25% or less of cells, 20% or less of cells, 15% or less of cells 10% or less of cells, 5% or less of cells, 4% or less of cells, 3% or less of cells, 2% or less of cells, 1% or less of cells, 0.5% or less of cells, 0.25% or less of cells, or 0.1% or less of cells. Such determinations can, in some cases, be determined using in vitro systems.

Another aspect of target sequence selection relates to homologous recombination events. Sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of DSBs, which occur on a regular basis during the normal cell replication cycle but can also be enhanced by the occurrence of various events (such as UV light and other inducers of DNA breakage) or the presence of certain agents (such as various chemical inducers). Many such inducers cause DSBs to occur indiscriminately in the genome, and DSBs can be regularly induced and repaired in normal cells. During repair, the original sequence can be reconstructed with complete fidelity, however, in some cases, small insertions or deletions (referred to as "indels") are introduced at the DSB site.

DSBs can also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that can comprise as few as ten base pairs or less, can also be used to bring about desired deletions. For example, a single DSB can be introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

The examples provided herein further illustrate the selection of various target regions for the creation of DSBs designed to induce replacements that result in restoration of RetGC1 protein activity, as well as the selection of specific target sequences within such regions that are designed to minimize off-target events relative to on-target events.

Homology Direct Repair (HDR)/Donor Nucleotides

Homology direct repair is a cellular mechanism for repairing DSBs. The most common form is homologous recombination. There are additional pathways for HDR, including single-strand annealing and alternative-HDR. Genome engineering tools allow researchers to manipulate the cellular homologous recombination pathways to create site-specific modifications to the genome. It has been found that cells can repair a double-stranded break using a synthetic donor molecule provided in trans. Therefore, by introducing a double-stranded break near a specific mutation and providing a suitable donor, targeted changes can be made in the genome. Specific cleavage increases the rate of HDR more than 1,000 fold above the rate of 1 in $10^6$ cells receiving a homologous donor alone. The rate of HDR at a particular nucleotide is a function of the distance to the cut site, so choosing overlapping or nearest target sites is important. Gene editing offers the advantage over gene addition, as correcting in situ leaves the rest of the genome unperturbed.

Supplied donors for editing by HDR vary markedly but can contain the intended sequence with small or large flanking homology arms to allow annealing to the genomic DNA. The homology regions flanking the introduced genetic changes can be 30 bp or smaller, or as large as a multi-kilobase cassette that can contain promoters, cDNAs, etc. Both single-stranded and double-stranded oligonucleotide donors have been used. These oligonucleotides range in size from less than 100 nt to over many kb, though longer ssDNA can also be generated and used. Double-stranded donors can be used, including PCR amplicons, plasmids, and mini-circles. In general, it has been found that an AAV vector can be a very effective means of delivery of a donor template, though the packaging limits for individual donors is <5 kb. Active transcription of the donor increased HDR three-fold, indicating the inclusion of promoter may increase conversion. Conversely, CpG methylation of the donor decreased gene expression and HDR.

Donor nucleotides for correcting mutations often are small (<300 bp). This is advantageous, as HDR efficiencies may be inversely related to the size of the donor molecule. Also, it is expected that the donor templates can fit into size constrained AAV molecules, which have been shown to be an effective means of donor template delivery.

In addition to wildtype endonucleases, such as Cas9, nickase variants exist that have one or the other nuclease domain inactivated resulting in cutting of only one DNA strand. HDR can be directed from individual Cas nickases or using pairs of nickases that flank the target area. Donors can be single-stranded, nicked, or dsDNA.

The donor DNA can be supplied with the nuclease or independently by a variety of different methods, for example by transfection, nanoparticle, microinjection, or viral transduction. A range of tethering options has been proposed to increase the availability of the donors for HDR. Examples include attaching the donor to the nuclease, attaching to DNA binding proteins that bind nearby, or attaching to proteins that are involved in DNA end binding or repair.

The repair pathway choice can be guided by a number of culture conditions, such as those that influence cell cycling, or by targeting of DNA repair and associated proteins. For example, to increase HDR, key NHEJ molecules can be suppressed, such as KU70, KU80 or DNA ligase IV.

Without a donor present, the ends from a DNA break or ends from different breaks can be joined using the several non-homologous repair pathways in which the DNA ends are joined with little or no base-pairing at the junction. In addition to canonical NHEJ, there are similar repair mechanisms, such as ANHEJ. If there are two breaks, the intervening segment can be deleted or inverted. NHEJ repair pathways can lead to insertions, deletions or mutations at the joints.

NHEJ was used to insert a 15-kb inducible gene expression cassette into a defined locus in human cell lines after nuclease cleavage. The methods of insertion of large inducible gene expression cassettes have been described [Maresca, M., Lin, V. G., Guo, N. & Yang, Y., *Genome Res* 23, 539-546 (2013), Suzuki et al. Nature, 540, 144-149 (2016))].

In addition to genome editing by NHEJ or HDR, site-specific gene insertions have been conducted that use both the NHEJ pathway and HDR. A combination approach can be applicable in certain settings, possibly including intron/exon borders. NHEJ may prove effective for ligation in the intron, while the error-free HDR may be better suited in the coding region.

Illustrative modifications within the GUCY2D gene include replacements within or near (proximal) to the mutations referred to above (i.e. R838H, R838C, or R838S mutations), such as within the region of less than 3 kb, less than 2 kb, less than 1 kb, less than 0.5 kb upstream or downstream of the specific mutation. Given the relatively wide variations of mutations in the GUCY2D gene, it will be appreciated that numerous variations of the replacements referenced above (including without limitation larger as well as smaller deletions), would be expected to result in restoration of the RetGC1 protein activity.

Such variants can include replacements that are larger in the 5' and/or 3' direction than the specific mutation in question, or smaller in either direction. Accordingly, by "near" or "proximal" with respect to specific replacements, it is intended that the SSB or DSB locus associated with a desired replacement boundary (also referred to herein as an endpoint) can be within a region that is less than about 3 kb from the reference locus, e.g., the mutation site. The SSB or DSB locus can be more proximal and within 2 kb, within 1 kb, within 0.5 kb, or within 0.1 kb. In the case of a small replacement, the desired endpoint can be at or "adjacent to" the reference locus, by which it is intended that the endpoint can be within 100 bp, within 50 bp, within 25 bp, or less than about 10 bp to 5 bp from the reference locus.

Larger or smaller replacements can provide the same benefit, as long as the RetGC1 protein activity is restored. It is thus expected that many variations of the replacements described and illustrated herein can be effective for ameliorating autosomal dominant CORD.

The terms "near" or "proximal" with respect to the SSBs or DSBs refer to the SSBs or DSBs being within 2 kb, within 1 kb, within 0.5 kb, within 0.25 kb, within 0.2 kb, or within 0.1 kb of the R838H, R838C, or R838S mutation.

Nucleic Acid Modifications (Chemical and Structural Modifications)

In some cases, polynucleotides introduced into cells can comprise one or more modifications that can be used individually or in combination, for example, to enhance activity, stability or specificity, alter delivery, reduce innate immune responses in host cells, or for other enhancements, as further described herein and known in the art.

In certain examples, modified polynucleotides can be used in the CRISPR/Cas9/Cpf1 system, in which case the guide RNAs (either single-molecule guides or double-molecule guides) and/or a DNA or an RNA encoding a Cas or Cpf1 endonuclease introduced into a cell can be modified, as described and illustrated below. Such modified polynucleotides can be used in the CRISPR/Cas9/Cpf1 system to edit any one or more genomic loci.

Using the CRISPR/Cas9/Cpf1 system for purposes of non-limiting illustrations of such uses, modifications of guide RNAs can be used to enhance the formation or stability of the CRISPR/Cas9/Cpf1 genome editing complex comprising guide RNAs, which can be single-molecule guides or double-molecule, and a Cas or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in aspects in which a Cas or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNAses present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9/Cpf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9/Cpf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high-performance liquid chromatography (HPLC, which avoids the use of gels such as PAGE) tends to become more challenging as polynucleotide lengths increase significantly beyond a hundred or so nucleotides. One approach that can be used for generating chemically modified RNAs of greater length is to produce two or more molecules that are ligated together. Much longer RNAs, such as those encoding a Cas9 endonuclease, are more readily generated enzymatically. While fewer types of modifications are available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some aspects a 2'-O-alkyl, 2'-O-alkyl-O-alkyl, or 2'-fluoro-modified nucleotide. In some examples, RNA modifications can comprise 2'-fluoro, 2'-amino or 2'-O-methyl modifications on the ribose of pyrimidines, abasic residues, or an inverted base at the 3' end of the RNA. Such modifications can be routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone), $CH_2$—O—N ($CH_3$)—$CH_2$, $CH_2$—N($CH_3$)—N($CH_3$)—$CH_2$ and O—N($CH_3$)— $CH_2$—$CH_2$ backbones, wherein the native phosphodiester backbone is represented as O— P— O— CH); amide backbones [see De Mesmaeker et al., Ace. Chem. Res., 28:366-374 (1995)]; morpholino backbone structures (see Summerton and Weller, U.S. Pat. No. 5,034, 506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177, 196; 5,188,897; 5,264,423; 5,276,019; 5,278,302; 5,286, 717; 5,321,131; 5,399,676; 5,405,939; 5,453,496; 5,455, 233; 5,466,677; 5,476,925; 5,519,126; 5,536,821; 5,541, 306; 5,550,111; 5,563,253; 5,571,799; 5,587,361; and 5,625, 050.

Morpholino-based oligomeric compounds are described in Braasch and David Corey, Biochemistry, 41(14): 4503-4510 (2002); Genesis, Volume 30, Issue 3, (2001); Heasman, Dev. Biol., 243: 209-214 (2002); Nasevicius et al., Nat. Genet., 26:216-220 (2000); Lacerra et al., Proc. Natl. Acad. Sci., 97: 9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122: 8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts; see U.S. Pat. Nos. 5,034,506; 5,166,315; 5,185, 444; 5,214,134; 5,216,141; 5,235,033; 5,264,562; 5,264, 564; 5,405,938; 5,434,257; 5,466,677; 5,470,967; 5,489, 677; 5,541,307; 5,561,225; 5,596,086; 5,602,240; 5,610, 289; 5,602,240; 5,608,046; 5,610,289; 5,618,704; 5,623, 070; 5,663,312; 5,633,360; 5,677,437; and 5,677,439.

One or more substituted sugar moieties can also be included, e.g., one of the following at the 2' position: OH, SH, $SCH_3$, F, OCN, $OCH_3OCH_3$, $OCH_3O(CH_2)n\ CH_3$, $O(CH_2)n\ NH_2$, or $O(CH_2)n\ CH_3$, where n is from 1 to about 10; C1 to C10 lower alkyl, alkoxyalkoxy, substituted lower alkyl, alkaryl or aralkyl; Cl; Br; CN; $CF_3$; $OCF_3$; O-, S-, or N-alkyl; O-, S-, or N-alkenyl; $SOCH_3$; $SO_2CH_3$; $ONO_2$; $NO_2$; $N_3$; $NH_2$; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some aspects, a modification includes 2'-methoxyethoxy (2'-O—$CH_2CH_2OCH_3$, also known as 2'-O-(2-methoxyethyl)) (Martin et al, Helv. Chim. Acta, 1995, 78, 486). Other modifications include 2'-methoxy (2'-O—$CH_3$), 2'-propoxy (2'-$OCH_2CH_2CH_3$) and 2'-fluoro (2'-F). Similar modifications can also be made at other positions on the oligonucleotide, particularly the 3' position of the sugar on the 3' terminal nucleotide and the 5' position of 5' terminal nucleotide. Oligonucleotides can also have sugar mimetics, such as cyclobutyls in place of the pentofuranosyl group.

In some examples, both a sugar and an internucleoside linkage, i.e., the backbone, of the nucleotide units can be replaced with novel groups. The base units can be maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide can be replaced with an amide containing backbone, for example, an aminoethylglycine backbone. The nucleobases can be retained and bound directly or indirectly to aza nitrogen atoms of the amide portion of the backbone. Representative U.S. patents that teach the preparation of PNA compounds comprise, but are not limited to, U.S. Pat. Nos. 5,539,082; 5,714,331; and 5,719,262. Further teaching of PNA compounds can be found in Nielsen et al, Science, 254: 1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, as well as synthetic nucleobases, e.g., 2-aminoadenine, 2-(methylamino) adenine, 2-(imidazolylalkyl)adenine, 2-(aminoalklyamino) adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl) adenine, and 2,6-diaminopurine. Kornberg, A., DNA Replication, W. H. Freeman & Co., San Francisco, pp. 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are aspects of base substitutions.

Modified nucleobases can comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine, and 3-deazaguanine and 3-deazaadenine.

Further, nucleobases can comprise those disclosed in U.S. Pat. No. 3,687,808, those disclosed in 'The Concise Encyclopedia of Polymer Science and Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds, 'Antisense Research and Applications', CRC Press, Boca Raton, 1993, pp. 276-278) and are aspects of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and U.S. Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications can be incorporated in a single oligonucleotide, or even in a single nucleoside within an oligonucleotide.

The guide RNAs and/or mRNA (or DNA) encoding an endonuclease can be chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86: 6553-6556 (1989)]; cholic acid [Manoharan et al., Bioorg. Med. Chem. Let., 4: 1053-1060 (1994)]; a thioether, e.g., hexyl-S-tritylthiol [Manoharan et al, Ann. N. Y. Acad. Sci., 660: 306-309 (1992) and Manoharan et al., Bioorg. Med. Chem. Let., 3: 2765-2770 (1993)]; a thiocholesterol [Oberhauser et al., Nucl. Acids Res., 20: 533-538 (1992)]; an aliphatic chain, e.g., dodecandiol or undecyl residues [Kabanov et al., FEBS Lett., 259: 327-330 (1990) and Svinarchuk et al., Biochimie, 75: 49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36: 3651-3654 (1995) and Shea et al., Nucl. Acids Res., 18: 3777-3783 (1990)]; a polyamine or a polyethylene glycol chain [Mancharan et al., Nucleosides & Nucleotides, 14: 969-973 (1995)]; adamantane acetic acid [Manoharan et al., Tetrahedron Lett., 36: 3651-3654 (1995)]; a palmityl moiety [(Mishra et al., Biochim. Biophys. Acta, 1264: 229-237 (1995)]; or an octadecylamine or hexylamino-carbonyl-t oxycholesterol moiety [Crooke et al., J. Pharmacol. Exp. Ther., 277: 923-937 (1996)]. See also U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599, 928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21(10):1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the present disclosure include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this present disclosure, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present disclosure. Representative conjugate groups are disclosed in International Patent Application No. PCT/US92/09196, filed Oct. 23, 1992 (published as WO1993007883), and U.S. Pat. No. 6,287,860. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine- 5'-Triphosphate (5-Methyl-CTP) or N6-Methyl-ATP), or treatment with phosphatase to remove 5' terminal phosphates. These and other modifications are known in the art, and new modifications of RNAs are regularly being developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7(5):618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs such as (m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6(4): 440-468 (2013); Kanasty et al., Molecular Therapy 20(3): 513-524 (2012); Burnett et al., Biotechnol J. 6(9):1130-46 (2011); Judge and MacLachlan, Hum Gene Ther 19(2):111-24 (2008).

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2: 77-96 (2011); Gaglione and Messere, Mini Rev Med Chem, 10(7):578-95 (2010); Chernolovskaya et al, Curr Opin Mol Ther., 12(2):158-67 (2010); Deleavey et al., Curr Protoc Nucleic Acid Chem Chapter 16:Unit 16.3 (2009); Behlke, Oligonucleotides 18(4):305-19 (2008); Fucini et al., Nucleic Acid Ther 22(3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (Tm), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013).

Codon-Optimization

A polynucleotide encoding a site-directed polypeptide can be codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Nucleic Acids Encoding System Components

The present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the aspects of the methods of the disclosure.

The nucleic acid encoding a genome-targeting nucleic acid of the disclosure, a site-directed polypeptide of the disclosure, and/or any nucleic acid or proteinaceous molecule necessary to carry out the aspects of the methods of the disclosure can comprise a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some examples, vectors can be capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, Calif. (1990). Regulatory sequences include those that direct constitutive expression of a nucleotide sequence in many types of host cells, and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Additional vectors contemplated for eukaryotic target cells include, but are not limited to, the vectors pCTx-1, pCTx-2, and pCTx-3. Other vectors can be used so long as they are compatible with the host cell.

In some examples, a vector can comprise one or more transcription and/or translation control elements. Depending on the host/vector system utilized, any of a number of suitable transcription and translation control elements, including constitutive and inducible promoters, transcription enhancer elements, transcription terminators, etc. can be used in the expression vector. The vector can be a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art, and additional information and approaches are regularly being described; see, e.g., Ma, H. et al., *Molecular Therapy—Nucleic Acids* 3, e161 (2014) doi:10.1038/mtna.2014.12.

The expression vector can also contain a ribosome binding site for translation initiation and a transcription terminator. The expression vector can also comprise appropriate sequences for amplifying expression. The expression vector can also include nucleotide sequences encoding non-native tags (e.g., histidine tag, hemagglutinin tag, green fluorescent protein, etc.) that are fused to the site-directed polypeptide, thus resulting in a fusion protein.

A promoter can be an inducible promoter (e.g., a heat shock promoter, tetracycline-regulated promoter, steroid-regulated promoter, metal-regulated promoter, estrogen receptor-regulated promoter, etc.). The promoter can be a constitutive promoter (e.g., CMV promoter, UBC promoter). In some cases, the promoter can be a spatially restricted and/or temporally restricted promoter (e.g., a tissue specific promoter, a cell type specific promoter, etc.).

The nucleic acid encoding a genome-targeting nucleic acid of the disclosure and/or a site-directed polypeptide can be packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

microRNAs (miRNAs)

Another class of gene regulatory regions is microRNA (miRNA) binding sites. miRNAs are non-coding RNAs that play key roles in post-transcriptional gene regulation. miRNAs can regulate the expression of 30% of all mammalian protein-encoding genes. Specific and potent gene silencing by double stranded RNA (RNAi) was discovered, plus additional small noncoding RNA (Canver, M. C. et al., Nature (2015)). The largest class of non-coding RNAs important for gene silencing is miRNAs. In mammals, miRNAs are first transcribed as long RNA transcripts, which can be separate transcriptional units, part of protein introns, or other transcripts. The long transcripts are called primary miRNA (pri-miRNA) that include imperfectly base-paired hairpin structures. These pri-miRNA can be cleaved into one or more shorter precursor miRNAs (pre-miRNAs) by Microprocessor, a protein complex in the nucleus, involving Drosha.

Pre-miRNAs are short stem loops ~70 nucleotides in length with a 2-nucleotide 3'-overhang that are exported into the mature 19-25 nucleotide miRNA:miRNA* duplexes. The miRNA strand with lower base pairing stability (the guide strand) can be loaded onto the RNA-induced silencing complex (RISC). The passenger guide strand (marked with *), can be functional, but is usually degraded. The mature miRNA tethers RISC to partly complementary sequence motifs in target mRNAs predominantly found within the 3' untranslated regions (UTRs) and induces posttranscriptional gene silencing (Bartel, D. P. *Cell* 136, 215-233 (2009); Saj, A. & Lai, E. C. *Curr Opin Genet Dev* 21, 504-510 (2011)).

miRNAs can be important in development, differentiation, cell cycle and growth control, and in virtually all biological pathways in mammals and other multicellular organisms. miRNAs can also be involved in cell cycle control, apoptosis and stem cell differentiation, hematopoiesis, hypoxia, muscle development, neurogenesis, insulin secretion, cholesterol metabolism, aging, viral replication and immune responses.

A single miRNA can target hundreds of different mRNA transcripts, while an individual transcript can be targeted by many different miRNAs. More than 28645 miRNAs have been annotated in the latest release of miRBase (v.21). Some miRNAs can be encoded by multiple loci, some of which can be expressed from tandemly co-transcribed clusters. The features allow for complex regulatory networks with multiple pathways and feedback controls. miRNAs can be integral parts of these feedback and regulatory circuits and can help regulate gene expression by keeping protein production within limits (Herranz, H. & Cohen, S. M. *Genes Dev* 24, 1339-1344 (2010); Posadas, D. M. & Carthew, R. W. *Curr Opin Genet Dev* 27, 1-6 (2014)).

miRNAs can also be important in a large number of human diseases that are associated with abnormal miRNA expression. This association underscores the importance of the miRNA regulatory pathway. Recent miRNA deletion studies have linked miRNAs with regulation of the immune responses (Stern-Ginossar, N. et al., *Science* 317, 376-381 (2007)).

miRNAs also have a strong link to cancer and can play a role in different types of cancer. miRNAs have been found to be downregulated in a number of tumors. miRNAs can be important in the regulation of key cancer-related pathways, such as cell cycle control and the DNA damage response, and can therefore be used in diagnosis and can be targeted clinically. miRNAs can delicately regulate the balance of angiogenesis, such that experiments depleting all miRNAs suppress tumor angiogenesis (Chen, S. et al., *Genes Dev* 28, 1054-1067 (2014)).

As has been shown for protein coding genes, miRNA genes can also be subject to epigenetic changes occurring with cancer. Many miRNA loci can be associated with CpG islands increasing their opportunity for regulation by DNA methylation (Weber, B., Stresemann, C., Brueckner, B. & Lyko, F. *Cell Cycle* 6, 1001-1005 (2007)). The majority of studies have used treatment with chromatin remodeling drugs to reveal epigenetically silenced miRNAs.

In addition to their role in RNA silencing, miRNAs can also activate translation (Posadas, D. M. & Carthew, R. W. *Curr Opin Genet Dev* 27, 1-6 (2014)). Knocking out these sites can lead to decreased expression of the targeted gene, while introducing these sites can increase expression.

Individual miRNAs can be knocked out most effectively by mutating the seed sequence (bases 2-8 of the miRNA), which can be important for binding specificity. Cleavage in this region, followed by mis-repair by NHEJ can effectively abolish miRNA function by blocking binding to target sites. miRNAs could also be inhibited by specific targeting of the special loop region adjacent to the palindromic sequence. Catalytically inactive Cas9 can also be used to inhibit shRNA expression (Zhao, Y. et al., *Sci Rep* 4, 3943 (2014)). In addition to targeting the miRNAs, the binding sites can also be targeted and mutated to prevent the silencing by miRNAs.

According to the present disclosure, any of the miRNAs or their binding sites can be incorporated into the compositions of the invention.

The compositions can have a region such as, but not limited to, a region comprising the sequence of any of the miRNAs listed in SEQ ID NOs: 613-4696, the reverse complement of the miRNAs listed in SEQ ID NOs: 613-4696, or the miRNA anti-seed region of any of the miRNAs listed in SEQ ID NOs: 613-4696.

The compositions of the invention can comprise one or more miRNA target sequences, miRNA sequences, or miRNA seeds. Such sequences can correspond to any known miRNA such as those taught in US Publication No. 2005/0261218 and US Publication No. 2005/0059005. As a non-limiting example, known miRNAs, their sequences, and their binding site sequences in the human genome are listed in SEQ ID NOs: 613-4696.

A miRNA sequence comprises a "seed" region, i.e., a sequence in the region of positions 2-8 of the mature miRNA, which sequence has perfect Watson-Crick complementarity to the miRNA target sequence. A miRNA seed can comprise positions 2-8 or 2-7 of the mature miRNA. In some examples, a miRNA seed can comprise 7 nucleotides (e.g., nucleotides 2-8 of the mature miRNA), wherein the seed-complementary site in the corresponding miRNA target is flanked by an adenine (A) opposed to miRNA position 1. In some examples, a miRNA seed can comprise 6 nucleotides (e.g., nucleotides 2-7 of the mature miRNA), wherein the seed-complementary site in the corresponding miRNA target is flanked by an adenine (A) opposed to miRNA position 1. See for example, Grimson A, Farh K K, Johnston W K, Garrett-Engele P, Lim L P, Bartel DP; Mol Cell. 2007 Jul. 6; 27(1):91-105. The bases of the miRNA seed have complete complementarity with the target sequence.

Identification of miRNAs, miRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/1eu.2011.356); Bartel Cell 2009 136: 215-233; Landgraf et al, Cell, 2007 129:1401-1414; Gentner and Naldini, Tissue Antigens. 2012 80:393-403.

For example, if the composition is not intended to be delivered to the liver but ends up there, then miR-122, a miRNA abundant in liver, can inhibit the expression of the sequence delivered if one or multiple target sites of miR-122 are engineered into the polynucleotide encoding that target sequence. Introduction of one or multiple binding sites for different miRNAs can be engineered to further decrease the longevity, stability, and protein translation hence providing an additional layer of tenability.

As used herein, the term "miRNA site" refers to a miRNA target site or a miRNA recognition site, or any nucleotide sequence to which a miRNA binds or associates. It should be understood that "binding" can follow traditional Watson-Crick hybridization rules or can reflect any stable association of the miRNA with the target sequence at or adjacent to the miRNA site.

Conversely, for the purposes of the compositions of the present disclosure, miRNA binding sites can be engineered out of (i.e. removed from) sequences in which they naturally occur in order to increase protein expression in specific tissues. For example, miR-122 binding sites can be removed to improve protein expression in the liver.

Specifically, miRNAs are known to be differentially expressed in immune cells (also called hematopoietic cells), such as antigen presenting cells (APCs) (e.g. dendritic cells and macrophages), macrophages, monocytes, B lymphocytes, T lymphocytes, granulocytes, natural killer cells, etc. Immune cell specific miRNAs are involved in immunogenicity, autoimmunity, the immune-response to infection, inflammation, as well as unwanted immune response after gene therapy and tissue/organ transplantation. Immune cells specific miRNAs also regulate many aspects of development, proliferation, differentiation and apoptosis of hematopoietic cells (immune cells). For example, miR-142 and miR-146 are exclusively expressed in the immune cells, particularly abundant in myeloid dendritic cells. Introducing the miR-142 binding site into the 3'-UTR of a polypeptide of the present disclosure can selectively suppress the gene expression in the antigen presenting cells through miR-142 mediated mRNA degradation, limiting antigen presentation in professional APCs (e.g. dendritic cells) and thereby preventing antigen-mediated immune response after gene delivery (see, Annoni A et al., blood, 2009, 114, 5152-5161.

In one example, miRNA binding sites that are known to be expressed in immune cells, in particular, the antigen presenting cells, can be engineered into the polynucleotides to suppress the expression of the polynucleotide in APCs through miRNA mediated RNA degradation, subduing the antigen-mediated immune response, while the expression of the polynucleotide is maintained in non-immune cells where the immune cell specific miRNAs are not expressed.

Many miRNA expression studies have been conducted, and are described in the art, to profile the differential expression of miRNAs in various cancer cells/tissues and other diseases. Some miRNAs are abnormally over-expressed in certain cancer cells and others are under-expressed. For example, miRNAs are differentially expressed in cancer cells (WO2008/154098, US2013/0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264); hepatocellular carcinoma (WO2012/151212, US2012/0329672, WO2008/054828, U.S. Pat. No. 8,252,538); lung cancer cells (WO2011/076143, WO2013/033640, WO2009/070653, US2010/0323357); cutaneous T-cell lymphoma (WO2013/011378); colorectal cancer cells (WO2011/0281756, WO2011/076142); cancer positive lymph nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/0316081, US2012/0283310, WO2010/018563.

Human Cells

For ameliorating autosomal dominant CORD or any disorder associated with GUCY2D, as described and illustrated herein, the principal targets for gene editing are human cells. For example, in the ex vivo methods, the human cells can be somatic cells, which after being modified using the techniques as described, can give rise to differentiated cells, e.g., photoreceptor cells or retinal progenitor cells. For example, in the in vivo methods, the human cells can be photoreceptor cells or retinal progenitor cells.

By performing gene editing in autologous cells that are derived from and therefore already completely matched with the patient in need, it is possible to generate cells that can be safely re-introduced into the patient, and effectively give rise to a population of cells that can be effective in ameliorating one or more clinical conditions associated with the patient's disease.

Progenitor cells (also referred to as stem cells herein) are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one aspect, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell can derive from a multipotent cell that itself is derived from a multipotent cell, and so on. While each of these multipotent cells can be considered stem cells, the range of cell types that each can give rise to can vary considerably. Some differentiated cells also have the capacity to give rise to cells of greater developmental potential. Such capacity can be natural or can be induced artificially upon treatment with various factors. In many biological instances, stem cells can also be "multipotent" because they can produce progeny of more than one distinct cell type, but this is not required for "stem-ness."

Self-renewal can be another important aspect of the stem cell. In theory, self-renewal can occur by either of two major mechanisms. Stem cells can divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a myocyte progenitor cell), which in turn can differentiate into other types of precursor cells further down the pathway (such as a myocyte precursor), and then to an end-stage differentiated cell, which plays a characteristic role in a certain tissue type, and can or cannot retain the capacity to proliferate further.

Edited Human Cells

Provided herein are methods for editing a R838H, R838C, or R838S mutation in a GUCY2D gene in a human cell. Provided herein are gRNAs for editing a R838H, R838C, or R838S mutation in a GUCY2D gene in a human cell.

These methods and/or gRNAs disclosed herein can be used to edit a population of human cells. A sufficient number of human cells within a cell population can be edited and used to treat a patient. For example, 95%, 90%, 85%, 80%, 75%, 70%, 65%, 60%, 55%, or 50% of the human cells within a cell population can be edited and used to treat a patient. In other examples, 45%, 40%, 35%, 30%, 25%, 20%, 15%, 10%, 5%, 1%, or 0.5% of the human cells within a cell population can be edited and used to treat a patient. In various examples, the edited human cells can be first selected and cultured to expand the number of edited cells before administering them to a patient.

Induced Pluripotent Stem Cells

The genetically engineered human cells described herein can be induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a progenitor cell to be administered to the subject (e.g., autologous cells).

Because the progenitors are essentially derived from an autologous source, the risk of engraftment rejection or allergic response can be reduced compared to the use of cells from another subject or group of subjects. In addition, the use of iPSCs negates the need for cells obtained from an embryonic source. Thus, in one aspect, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

The term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. Reprogramming can encompasse complete reversion of the differentiation state of a differentiated cell (e.g., a somatic cell) to a pluripotent state or a multipotent state. Reprogramming can encompasse complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain examples described herein, reprogramming of a differentiated cell (e.g., a somatic cell) can cause the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a myogenic stem cell). Reprogramming is also distinct from promoting the self-renewal or proliferation of cells that are already pluripotent or multipotent, although the compositions and methods described herein can also be of use for such purposes, in some examples.

Many methods are known in the art that can be used to generate pluripotent stem cells from somatic cells. Any such method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, Cell 126(4): 663-76 (2006). iPSCs resemble ES cells, as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germline transmission [see, e.g., Maherali and Hochedlinger, Cell Stem Cell. 3(6):595-605 (2008)], and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, Stem Cells Transl Med. 3(4):448-57 (2014); Barrett et al., Stem Cells Trans Med 3:1-6 sctm.2014-0121 (2014); Focosi et al., Blood Cancer Journal 4: e211 (2014). The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it cannot be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., Cell Stem Cell, 7(5):618-30 (2010). Reprogramming can be achieved by introducing a combination of nucleic acids encoding stem cell-associated genes, including, for example, Oct-4 (also known as Oct-3/4 or Pouf51), Sox1, Sox2, Sox3, Sox 15, Sox 18, NANOG, Klf1, Klf2, Klf4, Klf5, NR5A2, c-Myc, l-Myc, n-Myc, Rem2, Tert, and LIN28. Reprogramming using the methods and compositions described herein can further comprise introducing one or more of Oct-3/4, a member of the Sox family, a member of the Klf family, and a member of the Myc family to a somatic cell. The methods and compositions described herein can further comprise introducing one or more of each of Oct-4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one aspect the reprogramming is not effected by a method that alters the genome. Thus, in such examples, reprogramming can be achieved, e.g., without the use of viral or plasmid vectors.

The efficiency of reprogramming (i.e., the number of reprogrammed cells) derived from a population of starting cells can be enhanced by the addition of various agents, e.g., small molecules, as shown by Shi et al., Cell-Stem Cell 2:525-528 (2008); Huangfu et al., Nature Biotechnology 26(7):795-797 (2008) and Marson et al., Cell-Stem Cell 3: 132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(1,3-Dioxo-1H,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzamides (e.g., CI-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-Cl-UCHA (e.g., 6-(3-chlorophenylureido)caproic hydroxamic acid), AOE (2-amino-8-oxo-9, 10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers can be selected from the non-limiting group including SSEA3, SSEA4, CD9, Nanog, Fbx15, Ecat1, Esg1, Eras, Gdf3, Fgf4, Cripto, Dax1, Zpf296, Slc2a3, Rex1, Utf1, and Nat1. In one case, for example, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. Detection can involve not only RT-PCR, but can also include detection of protein markers. Intracellular markers can be best identified via RT-PCR, or protein detection methods such as immunocytochemistry, while cell surface markers are readily identified, e.g., by immunocytochemistry.

The pluripotent stem cell character of isolated cells can be confirmed by tests evaluating the ability of the iPSCs to differentiate into cells of each of the three germ layers. As one example, teratoma formation in nude mice can be used to evaluate the pluripotent character of the isolated clones. The cells can be introduced into nude mice and histology and/or immunohistochemistry can be performed on a tumor arising from the cells. The growth of a tumor comprising cells from all three germ layers, for example, further indicates that the cells are pluripotent stem cells.

Retinal Progenitor Cells and Photoreceptor Cells

In some examples, the genetically engineered human cells described herein are photoreceptor cells or retinal progenitor cells (RPCs). RPCs are multipotent progenitor cells that can give rise to all six neurons of the retina as well as the Müller glia. Müller glia are a type of retinal glial cells and are the major glial component of the retina. Their function is to support the neurons of the retina and to maintain retinal homeostasis and integrity. Müller glia isolated from adult human retinas have been shown to differentiate into rod photoreceptors. Functional characterization of such Müller glia-derived photoreceptors by patch-clamp recordings has revealed that their electrical properties are comparable to those of adult rods (Giannelli et al., 2011, Stem Cells, (2):344-56). RPCs are gradually specified into lineage-restricted precursor cells during retinogenesis, which then maturate into the terminally differentiated neurons or Müuller glia. Fetal-derived human retinal progenitor cells (hRPCs) exhibit molecular characteristics indicative of a retinal progenitor state up to the sixth passage. They demonstrate a gradual decrease in the percentages of KI67-, SOX2-, and vimentin-positive cells from passages 1 to 6, whereas a sustained expression of nestin and PAX6 is seen through passage 6. Microarray analysis of passage 1 hRPCs demonstrates the expression of early retinal developmental genes: VIM (vimentin), KI67, NES (nestin), PAX6, SOX2, HESS, GNL3, OTX2, DACH1, SIX6, and CHX10 (VSX2). The hRPCs are functional in nature and respond to excitatory neurotransmitters (Schmitt et al., 2009, Investigative Ophthalmology and Visual Sciences. 2009; 50(12):5901-8). The outermost region of the retina contains a supportive retinal pigment epithelium (RPE) layer, which maintains photoreceptor health by transporting nutrients and recycling shed photoreceptor parts. The RPE is attached to Bruch's membrane, an extracellular matrix structure at the interface between the choroid and retina. On the other side of the RPE, moving inwards towards the interior of the eye, there are three layers of neurons: lightsensing rod and cone photoreceptors, a middle layer of connecting neurons (amacrine, bipolar and horizontal cells) and the innermost layer of ganglion cells, which transmit signals originating in the photoreceptor layer through the optic nerve and into the brain. In some aspects, the genetically engineered human cells described herein are photoreceptor cells, which are specialized types of neurons found in the retina. Photoreceptors convert light into signals that are able to stimulate biological processes and are responsible for sight. Rods and cones are the two classic photoreceptor cells that contribute information to the visual system.

Isolating a Retinal Progenitor Cell and Photoreceptor Cell

Retinal cells, including progenitor cells may be isolated according to any method known in the art. For example, human retinal cells are isolated from fresh surgical specimens. The retinal pigment epithelium (RPE) is separated from the choroid by digesting the tissue with type IV collagenase and the retinal pigment epithelium patches are cultured. Following the growth of 100-500 cells from the explant, the primary cultures are passaged (Ishida M. et al., Current Eye Research 1998; 17(4):392-402) and characterized for expression of RPE markers. Rods are isolated by disruption of the biopsied retina using papain. Precautions are taken to avoid a harsh disruption and improve cell yield. The isolated cells are sorted to yield a population of pure rod cells and characterized further by immunostaining (Feodorova et al., MethodsX 2015; 2:39-46).

In order to isolate cones, neural retina is identified, cut-out, and placed on 10% gelatin. The inner retinal layers are isolated using a laser. The isolated cone monolayers are cultured for 18 hours and compared with untreated retinas by light microscopy and transmission microscopy to check for any structural damage. The cells are characterized for expression of cone-specific markers (Salchow et al., Current Eye Research 2001; 22).

In order to isolate retinal progenitor cells, the biopsied retina is minced with dual scalpels and digested enzymatically in an incubator at 37° C. The supernatants of the digested cells are centrifuged and the cells are resuspended in cell-free retinal progenitor-conditioned medium. The cells are transferred to fibronectin-coated tissue culture flasks containing fresh media and cultured (Klassen et al., Jornal of Neuroscience Research 2004; 77:334-343).

Creating Patient Specific iPSCs

One step of the ex vivo methods of the present disclosure can involve creating a patient-specific iPS cell, patient-specific iPS cells, or a patient specific iPS cell line. There are many established methods in the art for creating patient specific iPS cells, as described in Takahashi and Yamanaka 2006; Takahashi, Tanabe et al. 2007. For example, the creating step can comprise: a) isolating a somatic cell, such as a skin cell or fibroblast, from the patient; and b) introducing a set of pluripotency-associated genes into the somatic cell in order to induce the cell to become a pluripotent stem cell. The set of pluripotency-associated genes can be one or more of the genes selected from the group consisting of OCT4, SOX1, SOX2, SOX3, SOX15, SOX18, NANOG, KLF1, KLF2, KLF4, KLF5, c-MYC, n-MYC, REM2, TERT and LIN28.

Performing a Biopsy or Aspirate of the Patient's Bone Marrow

A biopsy or aspirate is a sample of tissue or fluid taken from the body. There are many different kinds of biopsies or aspirates. Nearly all of them involve using a sharp tool to remove a small amount of tissue. If the biopsy will be on the skin or other sensitive area, numbing medicine can be applied first. A biopsy or aspirate can be performed according to any of the known methods in the art. For example, in a bone marrow aspirate, a large needle is used to enter the pelvis bone to collect bone marrow.

Isolating a Mesenchymal Stem Cell

Mesenchymal stem cells can be isolated according to any method known in the art, such as from a patient's bone marrow or peripheral blood. For example, marrow aspirate can be collected into a syringe with heparin. Cells can be washed and centrifuged on a Percoll™ density gradient. Cells, such as blood cells, liver cells, interstitial cells, macrophages, mast cells, and thymocytes, can be separated using density gradient centrifugation media, Percoll™. The cells can then be cultured in Dulbecco's modified Eagle's medium (DMEM) (low glucose) containing 10% fetal bovine serum (FBS) (Pittinger M F, Mackay A M, Beck S C et al., Science 1999; 284:143-147).

Differentiation of Genome-Edited iPSCs into Other Cell Types

Another step of the ex vivo methods of the present disclosure can comprise differentiating the genome-edited iPSCs into photoreceptor cells. The differentiating step may be performed according to any method known in the art. For example, iPSCs can be used to generate retinal organoids and photoreceptors as described in the art (Phillips et al., Stem Cells, June 2014, 32(6): pgs. 1480-1492; Zhong et al. Nat. Commun., 2014, 5: pg 4047; Tucker et al., PLoS One, April 2011, 6(4): e18992). For example, hiPSC are differentiated into retinal progenitor cells using various treatments, including Wnt, Nodal, and Notch pathway inhibitors (Noggin, Dk1, LeftyA, and DAPT) and other growth factors. The retinal progenitor cells are further differentiated into photoreceptor cells, the treatment including: exposure to native retinal cells in coculture systems, RX+ or Mitf+ by subsequent treatment with retinoic acid and taurine, or exposure to several exogenous factors including Noggin, Dkk1, DAPT, and insulin-like growth factor (Yang et al., Stem Cells International 2016).

Differentiation of Genome-Edited Mesenchymal Stem Cells into Photoreceptor Cells or Retinal Progenitor Cells Another step of the ex vivo methods of the present disclosure can comprise differentiating the genome-edited mesenchymal stem cells into photoreceptor cells or retinal progenitor cells. The differentiating step can be performed according to any method known in the art.

Implanting Cells into Patients

Another step of the ex vivo methods of the present disclosure can comprise implanting the photoreceptor cells or retinal progenitor cells into patients. This implanting step can be accomplished using any method of implantation known in the art. For example, the genetically modified cells can be injected directly in the patient's blood or otherwise administered to the patient.

Another step of the ex vivo methods of the invention involves implanting the photoreceptor cells or retinal progenitor cells into patients. This implanting step can be accomplished using any method of implantation known in the art. For example, the genetically modified cells can be injected directly in the patient's eye or otherwise administered to the patient.

Genetically Modified Cells

The term "genetically modified cell" refers to a cell that comprises at least one genetic modification introduced by genome editing (e.g., using the CRISPR/Cas9/Cpf1 system). In some ex vivo examples herein, the genetically modified cell can be genetically modified progenitor cell. In some in vivo examples herein, the genetically modified cell can be a genetically modified photoreceptor cell or retinal progenitor cell. A genetically modified cell comprising an exogenous genome-targeting nucleic acid and/or an exogenous nucleic acid encoding a genome-targeting nucleic acid is contemplated herein.

The term "control treated population" describes a population of cells that has been treated with identical media, viral induction, nucleic acid sequences, temperature, confluency, flask size, pH, etc., with the exception of the addition of the genome editing components. Any method known in the art can be used to measure restoration of GUCY2D gene or protein expression or activity, for example Western Blot analysis of the RetGC1 protein or real time PCR for quantifying GUCY2D mRNA.

The term "isolated cell" refers to a cell that has been removed from an organism in which it was originally found, or a descendant of such a cell. Optionally, the cell can be cultured in vitro, e.g., under defined conditions or in the presence of other cells. Optionally, the cell can be later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some cases, the isolated population can be a substantially pure population of cells, as compared to the heterogeneous population from which the cells were isolated or enriched. In some cases, the isolated population can be an isolated population of human progenitor cells, e.g., a substantially pure population of human progenitor cells, as compared to a heterogeneous population of cells comprising human progenitor cells and cells from which the human progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating autosomal dominant CORD.

The term "substantially enriched" with respect to a particular cell population, refers to a population of cells that is at least about 10%, about 20%, about 30%, about 40%, about 50%, about 60%, about 70% or more with respect to the cells making up a total cell population.

The terms "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of progenitor cells, refers to a population of cells that contain fewer than about 20%, about 15%, about 10%, about 9%, about 8%, about 7%, about 6%, about 5%, about 4%, about 3%, about 2%, about 1%, or less than 1%, of cells that are not progenitor cells as defined by the terms herein.

Delivery

Guide RNA polynucleotides (RNA or DNA) and/or endonuclease polynucleotide(s) (RNA or DNA) can be delivered by viral or non-viral delivery vehicles known in the art. Alternatively, endonuclease polypeptide(s) can be delivered by viral or non-viral delivery vehicles known in the art, such as electroporation or lipid nanoparticles. In further alternative aspects, the DNA endonuclease can be delivered as one or more polypeptides, either alone or pre-complexed with one or more guide RNAs, or one or more crRNA together with a tracrRNA.

Polynucleotides can be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18: 1127-1133 (2011) (which focuses on non-viral delivery vehicles for siRNA that are also useful for delivery of other polynucleotides).

Polynucleotides, such as guide RNA, sgRNA, and mRNA encoding an endonuclease, can be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle can range in size from 1-1000 nm, 1-500 nm, 1-250 nm, 25-200 nm, 25-100 nm, 35-75 nm, or 25-60 nm.

LNPs can be made from cationic, anionic, or neutral lipids. Neutral lipids, such as the fusogenic phospholipid DOPE or the membrane component cholesterol, can be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs can also be comprised of hydrophobic lipids, hydrophilic lipids, or both hydrophobic and hydrophilic lipids.

Any lipid or combination of lipids that are known in the art can be used to produce a LNP. Examples of lipids used to produce LNPs are: DOTMA, DOSPA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids can be combined in any number of molar ratios to produce a LNP. In addition, the polynucleotide(s) can be combined with lipid(s) in a wide range of molar ratios to produce a LNP.

As stated previously, the site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP can be modified or unmodified. Likewise, the gRNA, crRNA, tracrRNA, or sgRNA can be modified or unmodified. Numerous modifications are known in the art and can be used.

The endonuclease and sgRNA can be generally combined in a 1:1 molar ratio. Alternatively, the endonuclease, crRNA and tracrRNA can be generally combined in a 1:1:1 molar ratio. However, a wide range of molar ratios can be used to produce a RNP.

AAV (Adeno Associated Virus)

A recombinant adeno-associated virus (AAV) vector can be used for delivery. Techniques to produce rAAV particles, in which an AAV genome to be packaged that includes the polynucleotide to be delivered, rep and cap genes, and helper virus functions are provided to a cell are standard in the art. Production of rAAV typically requires that the following components are present within a single cell (denoted herein as a packaging cell): a rAAV genome, AAV rep and cap genes separate from (i.e., not in) the rAAV genome, and helper virus functions. The AAV rep and cap genes can be from any AAV serotype for which recombinant virus can be derived, and can be from a different AAV serotype than the rAAV genome ITRs, including, but not limited to, AAV serotypes described herein. Production of pseudotyped rAAV is disclosed in, for example, international patent application publication number WO 01/83692.

AAV sequences disclosed herein can comprise sgRNAs that target one or more of the R838H mutation within the GUCY2D gene, the R838C mutation within the GUCY2D gene, and the R838S mutation within the GUCY2D gene. For example, pSIA012 comprises an AAV sequence (SEQ ID NO: 5506) that encodes a sgRNA that targets the R838H mutation within the GUCY2D gene (SEQ ID NO: 5464). SEQ ID NO: 5464 is SEQ ID NOs: 5285 (sgRNA protospacer sequence) and 5267 (sgRNA backbone sequence). Another plasmid (SEQ ID NO: 5470) comprises an AAV sequence that encodes a sgRNA that targets the R838H mutation within the GUCY2D gene (SEQ ID NO: 5465). SEQ ID NO: 5465 is SEQ ID NOs: 5286 (sgRNA protospacer sequence) and 5267 (sgRNA backbone sequence). pSIA015 comprises an AAV sequence (SEQ ID NO: 5507) that encodes a sgRNA that targets either the R838H mutation or the R838C mutation within the GUCY2D gene (SEQ ID NO: 5466). SEQ ID NO: 5466 is SEQ ID NOs: 5398 (sgRNA protospacer sequence) and 5267 (sgRNA backbone sequence).

AAV Serotypes

AAV particles packaging polynucleotides encoding compositions of the present disclosure, e.g., endonucleases, donor sequences, or RNA guide molecules, of the present disclosure can comprise or be derived from any natural or recombinant AAV serotype. According to the present disclosure, the AAV particles can utilize or be based on a serotype selected from any of the following serotypes, and variants thereof including but not limited to AAV1, AAV10, AAV106.1/hu.37, AAV11, AAV114.3/hu.40, AAV12, AAV127.2/hu.41, AAV127.5/hu.42, AAV128.1/hu.43, AAV128.3/hu.44, AAV130.4/hu.48, AAV145.1/hu.53, AAV145.5/hu.54, AAV145.6/hu.55, AAV16.12/hu.11, AAV16.3, AAV16.8/hu.10, AAV161.10/hu.60, AAV161.6/hu.61, AAV1-7/rh.48, AAV1-8/rh.49, AAV2, AAV2.5T, AAV2-15/rh.62, AAV223.1, AAV223.2, AAV223.4, AAV223.5, AAV223.6, AAV223.7, AAV2-3/rh.61, AAV24.1, AAV2-4/rh.50, AAV2-5/rh.51, AAV27.3, AAV29.3/bb.1, AAV29.5/bb.2, AAV2G9, AAV-2-pre-miRNA-101, AAV3, AAV3.1/hu.6, AAV3.1/hu.9, AAV3-11/rh.53, AAV3-3, AAV33.12/hu.17, AAV33.4/hu.15, AAV33.8/hu.16, AAV3-9/rh.52, AAV3a, AAV3b, AAV4, AAV4-19/rh.55, AAV42.12, AAV42-10, AAV42-11, AAV42-12, AAV42-13, AAV42-15, AAV42-1b, AAV42-2, AAV42-3a, AAV42-3b, AAV42-4, AAV42-5a, AAV42-5b, AAV42-6b, AAV42-8, AAV42-aa, AAV43-1, AAV43-12, AAV43-20, AAV43-21, AAV43-23, AAV43-25, AAV43-5, AAV4-4, AAV44.1, AAV44.2, AAV44.5, AAV46.2/hu.28, AAV46.6/hu.29, AAV4-8/r11.64, AAV4-8/rh.64, AAV4-9/rh.54, AAV5, AAV52.1/hu.20, AAV52/hu.19, AAV5-22/rh.58, AAV5-3/rh.57, AAV54.1/hu.21, AAV54.2/hu.22, AAV54.4R/hu.27, AAV54.5/hu.23, AAV54.7/hu.24, AAV58.2/hu.25, AAV6, AAV6.1, AAV6.1.2, AAV6.2, AAV7, AAV7.2, AAV7.3/hu.7, AAV8, AAV-8b, AAV-8h, AAV9, AAV9.11, AAV9.13, AAV9.16, AAV9.24, AAV9.45, AAV9.47, AAV9.61, AAV9.68, AAV9.84, AAV9.9, AAVA3.3, AAVA3.4, AAVA3.5, AAVA3.7, AAV-b, AAVC1, AAVC2, AAVC5, AAVCh.5, AAVCh.5R1, AAVcy.2, AAVcy.3, AAVcy.4, AAVcy.5, AAVCy.5R1, AAVCy.5R2, AAVCy.5R3, AAVCy.5R4, AAVcy.6, AAV-DJ, AAV-DJ8, AAVF3, AAVF5, AAV-h, AAVH-1/hu.1, AAVH2, AAVH-5/hu.3, AAVH6, AAVhE1.1, AAVhER1.14, AAVhEr1.16, AAVhEr1.18, AAVhER1.23, AAVhEr1.35, AAVhEr1.36, AAVhEr1.5, AAVhEr1.7, AAVhEr1.8, AAVhEr2.16, AAVhEr2.29, AAVhEr2.30, AAVhEr2.31, AAVhEr2.36, AAVhEr2.4, AAVhEr3.1, AAVhu.1, AAVhu.10, AAVhu.11, AAVhu.11, AAVhu.12, AAVhu.13, AAVhu.14/9, AAVhu.15, AAVhu.16, AAVhu.17, AAVhu.18, AAVhu.19, AAVhu.2, AAVhu.20, AAVhu.21, AAVhu.22, AAVhu.23.2, AAVhu.24, AAVhu.25, AAVhu.27, AAVhu.28, AAVhu.29, AAVhu.29R, AAVhu.3, AAVhu.31, AAVhu.32, AAVhu.34, AAVhu.35, AAVhu.37, AAVhu.39, AAVhu.4, AAVhu.40, AAVhu.41, AAVhu.42, AAVhu.43, AAVhu.44, AAVhu.44R1, AAVhu.44R2, AAVhu.44R3, AAVhu.45, AAVhu.46, AAVhu.47, AAVhu.48, AAVhu.48R1, AAVhu.48R2, AAVhu.48R3, AAVhu.49, AAVhu.5, AAVhu.51, AAVhu.52, AAVhu.53, AAVhu.54, AAVhu.55, AAVhu.56, AAVhu.57, AAVhu.58, AAVhu.6, AAVhu.60, AAVhu.61, AAVhu.63, AAVhu.64, AAVhu.66, AAVhu.67, AAVhu.7, AAVhu.8, AAVhu.9, AAVhu.t 19, AAVLG-10/rh.40, AAVLG-4/rh.38, AAVLG-9/hu.39, AAVLG-9/hu.39, AAV-LK01, AAV-LK02, AAVLK03, AAV-LK03, AAV-LK04, AAV-LK05, AAV-LK06, AAV-LK07, AAV-LK08, AAV-LK09, AAV-LK10, AAV-LK11, AAV-LK12, AAV-LK13, AAV-LK14, AAV-LK15, AAV-LK17, AAV-LK18, AAV-LK19, AAVN721-8/rh.43, AAV-PAEC, AAV-PAEC11, AAV-PAEC12, AAV-PAEC2, AAV-PAEC4, AAV-PAEC6, AAV-PAEC7, AAV-PAEC8, AAVpi.1, AAVpi.2, AAVpi.3, AAVrh.10, AAVrh.12, AAVrh.13, AAVrh.13R, AAVrh.14, AAVrh.17, AAVrh.18, AAVrh.19, AAVrh.2, AAVrh.20, AAVrh.21, AAVrh.22, AAVrh.23, AAVrh.24, AAVrh.25, AAVrh.2R, AAVrh.31, AAVrh.32, AAVrh.33, AAVrh.34, AAVrh.35, AAVrh.36, AAVrh.37, AAVrh.37R2, AAVrh.38, AAVrh.39, AAVrh.40, AAVrh.43, AAVrh.44, AAVrh.45, AAVrh.46, AAVrh.47, AAVrh.48, AAVrh.48, AAVrh.48.1, AAVrh.48.1.2, AAVrh.48.2, AAVrh.49, AAVrh.50, AAVrh.51, AAVrh.52, AAVrh.53, AAVrh.54, AAVrh.55, AAVrh.56, AAVrh.57, AAVrh.58, AAVrh.59, AAVrh.60, AAVrh.61, AAVrh.62, AAVrh.64, AAVrh.64R1, AAVrh.64R2, AAVrh.65, AAVrh.67, AAVrh.68, AAVrh.69, AAVrh.70, AAVrh.72, AAVrh.73, AAVrh.74, AAVrh.8, AAVrh.8R, AAVrh8R, AAVrh8R A586R mutant, AAVrh8R R533A mutant, BAAV, BNP61 AAV, BNP62 AAV, BNP63 AAV, bovine AAV, caprine AAV, Japanese AAV 10, true type AAV (ttAAV), UPENN AAV 10, AAV-LK16, AAAV, AAV Shuffle 100-1, AAV Shuffle 100-2, AAV Shuffle 100-3, AAV Shuffle 100-7, AAV Shuffle 10-2, AAV Shuffle 10-6, AAV Shuffle 10-8, AAV SM 100-10, AAV SM 100-3, AAV SM 10-1, AAV SM 10-2, and/or AAV SM 10-8.

In some examples, the AAV serotype can be, or have, a mutation in the AAV9 sequence as described by N Pulicherla et al. (Molecular Therapy 19(6):1070-1078 (2011), such as but not limited to, AAV9.9, AAV9.11, AAV9.13, AAV9.16, AAV9.24, AAV9.45, AAV9.47, AAV9.61, AAV9.68, AAV9.84.

In some examples, the AAV serotype can be, or have, a sequence as described in U.S. Pat. No. 6,156,303, such as, but not limited to, AAV3B (SEQ ID NO: 1 and 10 of U.S. Pat. No. 6,156,303), AAV6 (SEQ ID NO: 2, 7 and 11 of U.S. Pat. No. 6,156,303), AAV2 (SEQ ID NO: 3 and 8 of U.S. Pat. No. 6,156,303), AAV3A (SEQ ID NO: 4 and 9, of U.S. Pat. No. 6,156,303), or derivatives thereof.

In some examples, the serotype can be AAVDJ or a variant thereof, such as AAVDJ8 (or AAV-DJ8), as described by Grimm et al. (Journal of Virology 82(12): 5887-5911 (2008)). The amino acid sequence of AAVDJ8 can comprise two or more mutations in order to remove the heparin binding domain (HBD). As a non-limiting example, the AAV-DJ sequence described as SEQ ID NO: 1 in U.S. Pat. No. 7,588,772, can comprise two mutations: (1) R587Q where arginine (R; Arg) at amino acid 587 is changed to glutamine (Q; Gln) and (2) R590T where arginine (R; Arg) at amino acid 590 is changed to threonine (T; Thr). As another non-limiting example, can comprise three mutations: (1) K406R where lysine (K; Lys) at amino acid 406 is changed to arginine (R; Arg), (2) R587Q where arginine (R; Arg) at amino acid 587 is changed to glutamine (Q; Gln) and (3) R590T where arginine (R; Arg) at amino acid 590 is changed to threonine (T; Thr).

In some examples, the AAV serotype can be, or have, a sequence as described in International Publication No. WO2015121501, such as, but not limited to, true type AAV (ttAAV) (SEQ ID NO: 2 of WO2015121501), "UPenn AAV10" (SEQ ID NO: 8 of WO2015121501), "Japanese AAV10" (SEQ ID NO: 9 of WO2015121501), or variants thereof.

According to the present disclosure, AAV capsid serotype selection or use can be from a variety of species. In one example, the AAV can be an avian AAV (AAAV). The AAAV serotype can be, or have, a sequence as described in U.S. Pat. No. 9,238,800, such as, but not limited to, AAAV (SEQ ID NO: 1, 2, 4, 6, 8, 10, 12, and 14 of U.S. Pat. No. 9,238,800), or variants thereof.

In one example, the AAV can be a bovine AAV (BAAV). The BAAV serotype can be, or have, a sequence as described in U.S. Pat. No. 9,193,769, such as, but not limited to, BAAV (SEQ ID NO: 1 and 6 of U.S. Pat. No. 9,193,769), or variants thereof. The BAAV serotype can be or have a sequence as described in U.S. Pat. No. 7,427,396, such as, but not limited to, BAAV (SEQ ID NO: 5 and 6 of U.S. Pat. No. 7,427,396), or variants thereof.

In one example, the AAV can be a caprine AAV. The caprine AAV serotype can be, or have, a sequence as described in U.S. Pat. No. 7,427,396, such as, but not limited to, caprine AAV (SEQ ID NO: 3 of U.S. Pat. No. 7,427,396), or variants thereof.

In other examples the AAV can be engineered as a hybrid AAV from two or more parental serotypes. In one example, the AAV can be AAV2G9 which comprises sequences from AAV2 and AAV9. The AAV2G9 AAV serotype can be, or have, a sequence as described in United States Patent Publication No. US20160017005.

In one example, the AAV can be a serotype generated by the AAV9 capsid library with mutations in amino acids 390-627 (VP1 numbering) as described by Pulicherla et al. (Molecular Therapy 19(6):1070-1078 (2011). The serotype and corresponding nucleotide and amino acid substitutions can be, but is not limited to, AAV9.1 (G1594C; D532H), AAV6.2 (T1418A and T1436X; V473D and I479K), AAV9.3 (T1238A; F413Y), AAV9.4 (T1250C and A1617T; F417S), AAV9.5 (A1235G, A1314T, A1642G, C1760T; Q412R, T548A, A587V), AAV9.6 (T1231A; F411I), AAV9.9 (G1203A, G1785T; W595C), AAV9.10 (A1500G, T1676C; M559T), AAV9.11 (A1425T, A1702C, A1769T; T568P, Q590L), AAV9.13 (A1369C, A1720T; N457H, T574S), AAV9.14 (T1340A, T1362C, T1560C, G1713A; L447H), AAV9.16 (A1775T; Q592L), AAV9.24 (T1507C, T1521G; W503R), AAV9.26 (A1337G, A1769C; Y446C, Q590P), AAV9.33 (A1667C; D556A), AAV9.34 (A1534G, C1794T; N512D), AAV9.35 (A1289T, T1450A, C1494T, A1515T, C1794A, G1816A; Q430L, Y484N, N98K, V6061), AAV9.40 (A1694T, E565V), AAV9.41 (A1348T, T1362C; T450S), AAV9.44 (A1684C, A1701T, A1737G; N562H, K567N), AAV9.45 (A1492T, C1804T; N498Y, L602F), AAV9.46 (G1441C, T1525C, T1549G; G481R, W509R, L517V), 9.47 (G1241A, G1358A, A1669G; C1745T; S414N, G453D, K557E, T582I), AAV9.48 (C1445T, A1736T; P482L, Q579L), AAV9.50 (A1638T, C1683T, T1805A; Q546H, L602H), AAV9.53 (G1301A, A1405C, C1664T, G1811T; R134Q, S469R, A555V, G604V), AAV9.54 (C1531A, T1609A; L511I, L537M), AAV9.55 (T1605A; F535L), AAV9.58 (C1475T, C1579A; T492I, H527N), AAV.59 (T1336C; Y446H), AAV9.61 (A1493T; N498I), AAV9.64 (C1531A, A1617T; L511I), AAV9.65 (C1335T, T1530C, C1568A; A523D), AAV9.68 (C1510A; P504T), AAV9.80 (G1441A; G481R), AAV9.83 (C1402A, A1500T; P468T, E500D), AAV9.87 (T1464C, T1468C; S490P), AAV9.90 (A1196T; Y399F), AAV9.91 (T1316G, A1583T, C1782G, T1806C; L439R, K528I), AAV9.93 (A1273G, A1421G, A1638C, C1712T, G1732A, A1744T, A1832T; S425G, Q474R, Q546H, P571L, G578R, T582S, D611V), AAV9.94 (A1675T; M559L) and AAV9.95 (T1605A; F535L).

In one example, the AAV can be a serotype comprising at least one AAV capsid CD8+ T-cell epitope. As a non-limiting example, the serotype can be AAV1, AAV2 or AAV8.

In one example, the AAV can be a variant, such as PHP.A or PHP.B as described in Deverman. 2016. Nature Biotechnology. 34(2): 204-209.

In one example, the AAV can be a serotype selected from any of those found in SEQ ID NOs: 4697-5265 and Table 5.

In one example, the AAV can be encoded by a sequence, fragment or variant as described in SEQ ID NOs: 4697-5265 and Table 5.

A method of generating a packaging cell involves creating a cell line that stably expresses all of the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line can then be infected with a helper virus, such as adenovirus. The advantages of this method are that the cells are selectable and are suitable for large-scale production of rAAV. Other examples of suitable methods employ adenovirus or baculovirus, rather than plasmids, to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658,776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types can be transduced by the indicated AAV serotypes among others. See Table 5.

TABLE 5

Tissue/Cell Types and Serotypes

| Tissue/Cell Type | Serotype |
| --- | --- |
| Liver | AAV3, AA5, AAV8, AAV9 |
| Skeletal muscle | AAV1, AAV7, AAV6, AAV8, AAV9 |
| Central nervous system | AAV1, AAV4, AAV5, AAV8, AAV9 |
| RPE | AAV5, AAV4, AAV2, AAV8, AAV9, AAVrh8r |
| Photoreceptor cells | AAV5, AA8, AAV9, AAVrh8R |
| Lung | AAV9, AAV5 |
| Heart | AAV8 |
| Pancreas | AAV8 |
| Kidney | AAV2, AAV8 |

In addition to adeno-associated viral vectors, other viral vectors can be used. Such viral vectors include, but are not limited to, lentivirus, alphavirus, enterovirus, pestivirus, baculovirus, herpesvirus, Epstein Barr virus, papovavirusr, poxvirus, vaccinia virus, and herpes simplex virus.

In some cases, Cas9 mRNA, sgRNA targeting one or two loci in GUCY2D gene, and donor DNA can each be separately formulated into lipid nanoparticles, or are all co-formulated into one lipid nanoparticle.

In some cases, Cas9 mRNA can be formulated in a lipid nanoparticle, while sgRNA and donor DNA can be delivered in an AAV vector.

Options are available to deliver the Cas9 nuclease as a DNA plasmid, as mRNA or as a protein. The guide RNA can be expressed from the same DNA, or can also be delivered as an RNA. The RNA can be chemically modified to alter or improve its half-life, or decrease the likelihood or degree of immune response. The endonuclease protein can be complexed with the gRNA prior to delivery. Viral vectors allow efficient delivery; split versions of Cas9 and smaller orthologs of Cas9 can be packaged in AAV, as can donors for HDR. A range of non-viral delivery methods also exist that can deliver each of these components, or non-viral and viral methods can be employed in tandem. For example, nanoparticles can be used to deliver the protein and guide RNA, while AAV can be used to deliver a donor DNA.

Self-Inactivating (SIN) CRISPR-Cas Systems

Disclosed herein are "self-inactivating" (SIN) CRISPR-Cas systems. The SIN CRISPR-Cas system can comprise one or more segments. The SIN CRISPR-Cas system can be an AAV system. The SIN CRISPR-Cas system can be an AAVS system.

A first segment can comprise a nucleotide sequence that encodes one or more polypeptide inducing site-directed mutagenesis (e.g. Cas9 or Cpf1). The first segment can further comprise a start codon, a stop codon, and a poly (A) termination site. Such a polypeptide can be *Streptococcus pyogenes* Cas9 (SpCas9), *Staphylococcus aureus* Cas9 (SaCas9), or any variants thereof. A nucleotide sequence functioning as a promoter can be operably linked to the first segment. The promoter can be a spatially-restricted promoter, bidirectional promoter driving sgRNA in one direction and Cas9 in the opposite orientation, or an inducible promoter. The spatially-restricted promoter can be selected from the group consisting of: any ubiquitous promoter, any tissue or cell type specific promoter, a hepatocyte-specific promoter, a neuron-specific promoter, an adipocyte-specific promoter, a cardiomyocyte-specific promoter, a skeletal muscle-specific promoter, lung progenitor cell specific promoter, a photoreceptor-specific promoter, and a retinal pigment epithelial (RPE) selective promoter. The promoter can be a sEF1α promoter or GRK1 promoter.

A second segment can comprise a nucleotide sequence that encodes a sgRNA. The sgRNA can comprise any of SEQ ID NOs: 5282-5313 (FIG. 2A), 5398-5409, 5434-5443 (FIG. 2D) and 5464-5466. The sgRNAs can be substantially complementary to a SIN site and a genomic target sequence. By "hybridizable" or "complementary" or "substantially complementary" it is meant that a nucleic acid (e.g. RNA) comprises a sequence of nucleotides that enables it to non-covalently bind, e.g.: form Watson-Crick base pairs, "anneal", or "hybridize," to another nucleic acid in a sequence-specific, antiparallel manner (i.e., a nucleic acid specifically binds to a complementary nucleic acid) under the appropriate in vitro and/or in vivo conditions of temperature and solution ionic strength. As is known in the art, standard Watson-Crick base-pairing includes: adenine (A) pairing with thymidine (T), adenine (A) pairing with uracil (U), and guanine (G) pairing with cytosine (C) [DNA, RNA]. In some examples, the sgRNAs may be fully complementary to the nucleotide sequence of the SIN site except for in at least one location. In some examples, the sgRNAs may be fully complementary to the nucleotide sequence of the SIN site except for in at least two locations.

One or more third segments can be located at a 5' end of the first segment (upstream of the start codon and/or downstream of the transcriptional start site) or at a 3' end of a first segment (between the stop codon and poly (A) termination site). The one or more third segments can be located at the 5' end of the first segment and the 3' end of a first segment. The third segment can be less than 100 nucleotides in length. For example, the third segment can be 20-99, 30-99, 40-99, 50-99, 60-99, 70-99, 80-99, and 90-99 nucleotides in length. The third segment can be less than 50 nucleotides in length. For example, the third segment can be 20-49, 25-49, 30-49, 35-49, 40-49, and 45-49 nucleotides in length.

The one or more third segments can comprise a self-inactivating (SIN) site. The SIN site or R838 target site, as used herein, is either (1) a 20-50 nucleotide sequence of the GUCY2D gene comprising the R838H mutation (SEQ ID NO: 5478, 5479, and 5480), (2) a 20-50 nucleotide sequence of the GUCY2D gene comprising the R838C mutation (SEQ ID NOs: 5481, 5482, and 5483), (3) a 20-50 nucleotide sequence of the GUCY2D gene comprising the R838S mutation (SEQ ID NOs: 5484, 5485, and 5486), (4) a 20-50 nucleotide sequence of the GUCY2D gene comprising a combination of the R838C mutation and R838H mutation (SEQ ID NOs: 5490, 5491, and 5492), or (5) a 20-50 nucleotide sequence of the GUCY2D gene comprising a combination of the R838S mutation and R838H mutation (SEQ ID NOs: 5487, 5488, and 5489) (Table 6). The SIN site comprises protospacer adjacent motifs (PAMs).

comprising SEQ ID NOs: 5282-5313, 5398-5409, and 5434-5443 even though one or more of these sgRNAs may not be fully complementary to the nucleotide sequence of the SIN site in at least 1-2 locations. SIN sites that comprise a 20-50 nucleotide sequence of the GUCY2D gene comprising a combination of both the R838C mutation and R838H mutation can be targeted with any of the sgRNAs comprising SEQ ID NOs: 5282-5313, 5398-5409, and 5434-5443 even though one or more of these sgRNAs may not be fully complementary to the nucleotide sequence of the SIN site in at least 1-2 locations. SIN sites that comprise a 20-50 nucleotide sequence of the GUCY2D gene comprising a

TABLE 6

| SIN-AAV SpCas9 | SEQ ID NO: | 5' SIN site sequence | Allele(s) |
|---|---|---|---|
| SIN-AAV SpCas9 ver. 1 | 5478 | ggaggatctgatccgggagcacacggaggagctgga | H |
| SIN-AAV SpCas9 ver. 1 | 5481 | ggaggatctgatccgggagtgcacggaggagctgga | C |
| SIN-AAV SpCas9 ver. 1 | 5484 | ggaggatctgatccgggagagcacggaggagctgga | S |
| SIN-AAV SpCas9 ver. 1 | 5487 | ggaggatctgatccgggagaacacggaggagctgga | SH |
| SIN-AAV SpCas9 ver. 1 | 5490 | ggaggatctgatccgggagtacacggaggagctgga | CH |
| SIN-AAV SpCas9 ver. 2 | 5479 | aggatctgatccgggagcacacggaggagctgga | H |
| SIN-AAV SpCas9 ver. 2 | 5482 | aggatctgatccgggagtgcacggaggagctgga | C |
| SIN-AAV SpCas9 ver. 2 | 5485 | aggatctgatccgggagagcacggaggagctgga | S |
| SIN-AAV SpCas9 ver. 2 | 5488 | aggatctgatccgggagaacacggaggagctgga | SH |
| SIN-AAV SpCas9 ver. 2 | 5491 | aggatctgatccgggagtacacggaggagctgga | CH |

| SIN-AAV SpCas9 | SEQ ID NO: | 3' SIN site sequence | Allele(s) |
|---|---|---|---|
| SIN-AAV SpCas9 ver. 1 & 2 | 5480 | tccagctcctccgtgtgctcccggatcagatcctcc | H |
| SIN-AAV SpCas9 ver. 1 & 2 | 5483 | tccagctcctccgtgtcactcccggatcagatcctcc | C |
| SIN-AAV SpCas9 ver. 1 & 2 | 5486 | tccagctcctccgtgctctcccggatcagatcctcc | S |
| SIN-AAV SpCas9 ver. 1 & 2 | 5489 | tccagctcctccgtgttctcccggatcagatcctcc | SH |
| SIN-AAV SpCas9 ver. 1 & 2 | 5492 | tccagctcctccgtgtactcccggatcagatcctcc | CH |

The spacer sequence of a gRNA or sgRNA hybridizes to the strand complementary to the protospacer sequence located within the SIN site, which leads to editing by the gRNA-endonuclease complex or the sgRNA-endonuclease complex and eventually results in inactivation of the endonuclease (e.g. Cas9 or Cpf1). SIN sites that comprise a 20-50 nucleotide sequence of the GUCY2D gene comprising the R838H mutation can be targeted with any of the sgRNAs comprising SEQ ID NOs: 5282-5313, 5398-5409, and 5434-5443 even though one or more of the sgRNAs may not be fully complementary to the nucleotide sequence of the SIN site in at least 1-2 locations. SIN sites that comprise a 20-50 nucleotide sequence of the GUCY2D gene comprising the R838C mutation can be targeted with any of the sgRNAs comprising SEQ ID NOs: 5282-5313, 5398-5409, and 5434-5443 even though one or more of these sgRNAs may not be fully complementary to the nucleotide sequence of the SIN site in at least 1-2 locations. SIN sites that comprise a 20-50 nucleotide sequence of the GUCY2D gene comprising the R838S mutation can be targeted with any of the sgRNAs combination of both the R838S mutation and R838H mutation can be targeted with any of the sgRNAs comprising SEQ ID NOs: 5282-5313, 5398-5409, and 5434-5443 even though one or more of these sgRNAs may not be fully complementary to the nucleotide sequence of the SIN site in at least 1-2 locations.

In other examples, the SIN site can be shorter in length compared to the sequences listed in Table 6. For example, the SIN site can be any one of the sequences in SEQ ID NOs: 5324-5355 (FIG. 2B) and a PAM. The SIN site can be any one of the sequences in 5410-5421 (FIG. 2E) and a PAM. The SIN site can be any one of the sequences in 5444-5453 (FIG. 2E) and a PAM. The SIN site can be any one of the sequences in SEQ ID NOs: 5366-5397 (FIG. 2C) and a PAM. The SIN site can be any one of the sequences in SEQ ID NOs: 5422-5433 (FIG. 2F) and a PAM. The SIN site can be any one of the sequences in 5454-5463 (FIG. 2F) and a PAM.

In other examples, the SIN site can be shorter than the corresponding protospacer sequence of the sgRNA. For example, a protospacer sequence for a sgRNA may be 20 nucleotides in length whereas the corresponding SIN site may be shorter (only 19, 18, or 17 nucleotides in length) and a PAM. This shortened SIN site (that still corresponds to the spacer sequence of the sgRNA) will allow the genomic target sequence to be cleaved more efficiently than the shortened SIN site. For this reason, any one of the sequences in SEQ ID NOs: 5324-5355 (FIG. 2B), SEQ ID NOs: 5410-5421 (FIG. 2E), SEQ ID NOs: 5444-5453 (FIG. 2E), SEQ ID NOs: 5366-5397 (FIG. 2C), SEQ ID NOs: 5422-5433 (FIG. 2F), and SEQ ID NOs: 5454-5463 (FIG. 2F) can be shortened by 1, 2, or 3 nucleotides and used as a SIN site along with a PAM sequence. In these examples, the SIN sites may be less than 20 nucleotides in length.

In the SIN-AAV system, the endonuclease can be guided by one or more sgRNAs to one or more genomic target sequences. The one or more genomic target sequences can be a R838H mutation within the GUCY2D gene, a R838C mutation within the GUCY2D gene, or a R838S mutation within the GUCY2D gene. The endonuclease can be further guided to the SIN-AAV system that is expressing the endonuclease and the system's components. Examples of SIN-AAV system components that can be targeted include: essential sequences of a vector of the SIN-AAV system (e.g. viral inverted terminal repeats), promoters driving expression of genes important for editing (e.g. sgRNA or endonuclease genes), the open reading frame (ORF) of Cas9 or Cpf1, introns of encoded genes, or non-coding regions located 5' or 3' of the Cas9 or Cpf1 ORF (SIN sites). This leads to self-limiting editing activity which results in editing of one or more target genomic loci, and, thereafter, reduced or eliminated expression of the endonuclease and/or other essential components of the system (e.g. sgRNAs). This self-limited expression of genes in the SIN-AAV system can result in reduced off-target editing and reduced risk of successfully edited cells being targeted by the patient's immune system.

One or more vectors can encode the disclosed SIN-AAV systems. If only one vector encodes the entire SIN-AAV system, then the system is referred to as an "all-in-one" SIN system. For example, the first segment, second segment, and third segment can be provided together in an "all-in-one" SIN AAV system. If two vectors encode the entire SIN-AAV system, then the system is referred to as an "all-in-two" SIN system. For example, the first segment and third segment can be provided in a first vector and the second segment can be provided in a second vector for an "all-in-two" SIN AAV system.

All-in-One SIN-AAV Systems

In one example, an all-in-one SIN system can comprise a vector comprising an endonuclease ORF and a sgRNA gene. The vector can further comprise SIN sites at locations 5' and 3' of the endonuclease ORF. The sgRNA can be substantially complementary to the SIN site. The sgRNA can also be substantially complementary to a genomic target sequence. Thus, the sequence of the sgRNA is such that it can hybridize with both the SIN sites on the vector and with one or more genomic target sequences. When hybridizing with the one or more genomic targets or with the SIN sites, the sgRNA may comprise one or more mismatched bases. The system can lead to self-limited editing at the targeted genomic loci, followed by excision and/or inactivation of the endonuclease gene.

In another example, an all-in-one SIN system can comprise a vector comprising an endonuclease ORF, a first sgRNA gene, and a second sgRNA gene. The vector can further comprise SIN sites at locations 5' and 3' of the endonuclease ORF. The sequence of the first sgRNA is such that it can hybridize with one or more genomic target sequences. The sequence of the second sgRNA is such that it can hybridize with the SIN sites on the vector. When hybridizing with the one or more genomic targets or with the SIN sites, the sgRNAs can comprise one or more mismatched bases. Additional sgRNAs can be incorporated into the system to allow for editing of additional genomic or SIN system targets. The system can lead to self-limited editing at the targeted genomic loci, followed by excision and/or inactivation of the endonuclease gene.

In another example, an all-in-one SIN system can comprise a vector comprising an endonuclease ORF, a first sgRNA gene, and a second sgRNA gene. The sequence of the first sgRNA is such that it can hybridize with one or more genomic target sequences. The sequence of the second sgRNA is such that it can hybridize within or near the endonuclease ORF (Cas9 or Cpf1) on the vector, leading to inactivation of the endonuclease gene via indel generation. Additional sgRNAs can be incorporated into the system to allow for editing of additional genomic or SIN system targets. When hybridizing with the one or more genomic targets or the endonuclease ORF, the two or more sgRNAs may comprise one or more mismatched bases. The system can lead to self-limited editing at the targeted genomic loci, followed by inactivation of the endonuclease gene.

In all-in-one systems such as those described above, production of appropriate viral vectors can be challenging due to inactivation of the endonuclease gene that occurs earlier than desired and accumulation of mutagenized SIN sites on DNA packaged in AAV capsids (e.g. during production and packaging of the viral vector in a cell line of choice). To solve this problem, the endonuclease ORF and/or the sgRNA genes that direct editing at the endonuclease gene locus can be expressed from one or more cell/tissue-specific promoters. The cell/tissue specific promoters can be active in the cells where editing is desired and inactive earlier in the cells used for production and packaging of the vectors. In addition, one or more inducible promoter systems can be used to control expression of genes of interest, such as tetracycline-controlled transcriptional activation (i.e. tet-ON or tet-OFF). Other solutions to the premature inactivation problem include regulating gene expression with miRNAs, small interfering RNAs, short hairpin RNAs, other antisense oligonucleotides, blocking transcription of sgRNA (e.g. the use of a tet-OFF system), or inhibiting sgRNA loading onto Cas9.

All-in-Two SIN-AAV Systems

Figure 11D:
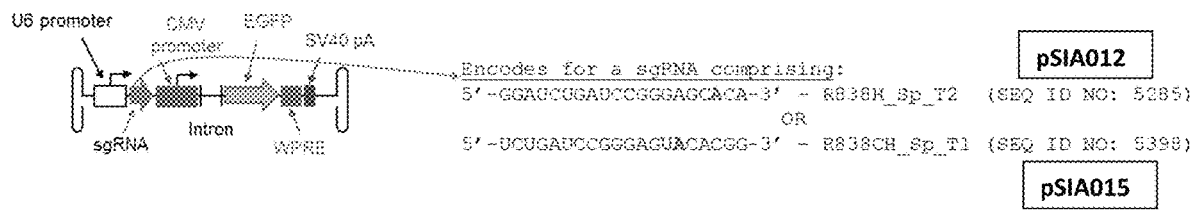

In one example, an all-in-two SIN system can comprise a first vector to provide an ORF encoding an endonuclease (FIGS. 11A-B or 14A-B). SIN sites can flank the endonuclease ORF at 5' and 3' locations on the first vector (FIG. 11A-B or 14A-B). The SIN site can be any one of SEQ ID NOs: 5478-5492, as shown in Table 6. The SIN site can be shorter in length compared to the sequences listed in Table 6. For example, the SIN site can be any one of the sequences in SEQ ID NOs: 5324-5355 (FIG. 2B) and a PAM. The SIN site can be any one of the sequences in 5410-5421 (FIG. 2E) and a PAM. The SIN site can be any one of the sequences in 5444-5453 (FIG. 2E) and a PAM. The SIN site can be any one of the sequences in SEQ ID NOs: 5366-5397 (FIG. 2C) and a PAM. The SIN site can be any one of the sequences in SEQ ID NOs: 5422-5433 (FIG. 2F) and a PAM. The SIN site can be any one of the sequences in 5454-5463 (FIG. 2F) and a PAM. In other examples, the SIN site can be shorter than the corresponding protospacer sequence of the sgRNA. For example, a protospacer sequence for a sgRNA may be 20 nucleotides in length whereas the corresponding SIN site may be shorter (only 19, 18, or 17 nucleotides in length) and a PAM. This shortened SIN site (that still corresponds to the spacer sequence of the sgRNA) will allow the genomic target sequence to be cleaved more efficiently than the shortened SIN site. For this reason, any one of the sequences in SEQ ID NOs: 5324-5355 (FIG. 2B), SEQ ID NOs: 5410-5421 (FIG. 2E), SEQ ID NOs: 5444-5453 (FIG. 2E), SEQ ID NOs: 5366-5397 (FIG. 2C), SEQ ID NOs: 5422-5433 (FIG. 2F), and SEQ ID NOs: 5454-5463 (FIG. 2F) can be shortened by 1, 2, or 3 nucleotides and used as a SIN site along with a PAM sequence. In a second vector, a single sgRNA can be encoded (FIG. 11D). The sgRNA can comprise any of SEQ ID NOs: 5282-5313 (FIG. 2A), 5398-5409 (FIG. 2D), 5434-5443 (FIG. 2D) and 5464-5466. The sgRNA can be substantially complementary to the SIN site. The sgRNA can also be substantially complementary to a genomic target sequence. Thus, the sequence of the sgRNA can be such that it can hybridize with both the SIN sites on the first vector and with one or more genomic target sequences (e.g. the R838H mutation within GUCY2D, the R838C mutation within GUCY2D, or the R838S mutation within GUCY2D). When hybridizing with the one or more genomic targets or with the SIN sites, the sgRNA may comprise one or more mismatched bases. The system can lead to self-limited editing at the targeted genomic loci, followed by excision and/or inactivation of the endonuclease gene.

In another example, an all-in-two SIN system can comprise a first vector to provide an ORF encoding an endonuclease. SIN sites can flank the endonuclease ORF at 5' and 3' locations on the first vector. The SIN site can be any one of SEQ ID NOs: 5478-5492, as shown in Table 6. The SIN site can be shorter in length compared to the sequences listed in Table 6. For example, the SIN site can be any one of the sequences in SEQ ID NOs: 5324-5355 (FIG. 2B) and a PAM. The SIN site can be any one of the sequences in 5410-5421 (FIG. 2E) and a PAM. The SIN site can be any one of the sequences in 5444-5453 (FIG. 2E) and a PAM. The SIN site can be any one of the sequences in SEQ ID NOs: 5366-5397 (FIG. 2C) and a PAM. The SIN site can be any one of the sequences in SEQ ID NOs: 5422-5433 (FIG. 2F) and a PAM. The SIN site can be any one of the sequences in 5454-5463 (FIG. 2F) and a PAM. In other examples, the SIN site can be shorter than the corresponding protospacer sequence of the sgRNA. For example, a protospacer sequence for a sgRNA may be 20 nucleotides in length whereas the corresponding SIN site may be shorter (only 19, 18, or 17 nucleotides in length) and a PAM. This shortened SIN site (that still corresponds to the spacer sequence of the sgRNA) will allow the genomic target sequence to be cleaved more efficiently than the shortened SIN site. For this reason, any one of the sequences in SEQ ID NOs: 5324-5355 (FIG. 2B), SEQ ID NOs: 5410-5421 (FIG. 2E), SEQ ID NOs: 5444-5453 (FIG. 2E), SEQ ID NOs: 5366-5397 (FIG. 2C), SEQ ID NOs: 5422-5433 (FIG. 2F), and SEQ ID NOs: 5454-5463 (FIG. 2F) can be shortened by 1, 2, or 3 nucleotides and used as a SIN site along with a PAM sequence. The all-in-two system can further comprise a second vector, comprising two sgRNA genes. When expressed from the second vector, a first sgRNA can bind with an endonuclease molecule and direct editing at one or more genomic target loci (e.g. the R838H mutation within GUCY2D, the R838C mutation within GUCY2D, or the R838S mutation within GUCY2D). The first sgRNA can comprise any of SEQ ID NOs: 5282-5313 (FIG. 2A), 5398-5409, 5434-5443 (FIG. 2D) and 5464-5466. When expressed from the second vector, a second sgRNA can bind with an endonuclease molecule and direct editing at the SIN sites. Additional sgRNAs can be incorporated into the system to allow for editing of additional genomic or SIN system targets. When hybridizing with the one or more genomic targets or with the SIN sites, the two or more sgRNAs may comprise one or more mismatched bases. In some examples, the one or more sgRNAs that target genomic loci may be encoded on the first vector, or a combination of both the first and second vectors. The system can lead to self-limited editing at the targeted genomic loci, followed by excision and/or inactivation of the endonuclease gene.

In another example, an all-in-two SIN system can comprise a first vector comprising an endonuclease ORF, and a second vector comprising two sgRNA genes. When expressed from the second vector, a first sgRNA can bind with an endonuclease molecule and direct editing at one or more genomic target loci (e.g. the R838H mutation within GUCY2D, the R838C mutation within GUCY2D, or the R838S mutation within GUCY2D). The first sgRNA can comprise any of SEQ ID NOs: 5282-5313 (FIG. 2A), 5398-5409, 5434-5443 (FIG. 2D) and 5464-5466. When expressed from the second vector, a second sgRNA can bind with an endonuclease molecule and direct editing within or near the endonuclease ORF (Cas9 or Cpf1) on the first vector, leading to inactivation of the endonuclease gene via indel generation. Additional sgRNAs can be incorporated into the system to allow for editing of additional genomic or SIN system targets. When hybridizing with the one or more genomic targets or within or near the endonuclease ORF, the two or more sgRNAs may comprise one or more mismatched bases. In some examples, the one or more sgRNAs that target genomic loci may be encoded on the first vector, or a combination of both the first and second vectors. The system can lead to self-limited editing at the targeted genomic loci, followed by inactivation of the endonuclease gene.

Lentivirus

In some aspects, lentiviral vectors or particles can be used as delivery vehicles. Lentiviruses (LV) are subgroup of the Retroviridae family of viruses. Lentiviral particles are able to integrate their genetic material into the genome of a target/host cell. Examples of lentivirus include the Human Immunodeficiency Viruses: HIV-1 and HIV-2, Jembrana Disease Virus (JDV), equine infectious anemia virus (EIAV), equine infectious anemia virus, visna-maedi and caprine arthritis encephalitis virus (CAEV), the Simian Immunodeficiency Virus (SIV), feline immunodeficiency virus (FIV), bovine immunodeficiency virus (BIV). LV's are capable of infecting both dividing and non-dividing cells due to their unique ability to pass through a target cell's intact nuclear membrane Greenberg et al., University of Berkeley, California; 2006). Lentiviral particles that form the gene delivery vehicle are replication defective and are generated by attenuating the HIV virulence genes. For example, the genes Vpu, Vpr, Nef, Env, and Tat are excised making the vector biologically safe. Lentiviral vehicles, for example, derived from HIV-1/HIV-2 can mediate the efficient delivery, integration and long-term expression of transgenes into non-dividing cells. As used herein, the term "recombinant" refers to a vector or other nucleic acid containing both lentiviral sequences and non-lentiviral retroviral sequences.

In order to produce a lentivirus that is capable of infecting host cells, three types of vectors need to be co-expressed in virus producing cells: a backbone vector containing the transgene of interests and self-inactivating 3'-LTR regions, one construct expressing viral structure proteins, and one vector encoding vesicular stomatitis virus glycoprotein (VSVG) for encapsulation (Naldini, L. et al., Science 1996; 272, 263-267). Separation of the Rev gene from other structural genes further increases the biosafety by reducing the possibility of reverse recombination. Cell lines that can be used to produce high-titer lentiviral particles may include, but are not limited to 293T cells, 293FT cells, and 293SF-3F6 cells (Witting et al., Human Gene Therapy, 2012; 23: 243-249; Ansorge et al., Joural of Genetic Medicne, 2009; 11: 868-876).

Methods for generating recombinant lentiviral particles are discussed in the art, for example, WO 2013076309 (PCT/EP2012/073645); WO 2009153563 (PCT/GB2009/001527); U.S. Pat. Nos. 7,629,153; and 6,808,905.

Cell types such as photoreceptors, retinal pigment epithelium, and ganglion cells have been successfully targeted with LV vector. The efficiency of delivery to photoreceptors and ganglion cells is significantly higher with AAV than LV vectors.

Pharmaceutically Acceptable Carriers

The ex vivo methods of administering progenitor cells to a subject contemplated herein involve the use of therapeutic compositions comprising progenitor cells.

Therapeutic compositions can contain a physiologically tolerable carrier together with the cell composition, and optionally at least one additional bioactive agent as described herein, dissolved or dispersed therein as an active ingredient. In some cases, the therapeutic composition is not substantially immunogenic when administered to a mammal or human patient for therapeutic purposes, unless so desired.

In general, the progenitor cells described herein can be administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition can depend on the nature of the disorder or condition, and can be determined by standard clinical techniques.

Guide RNA Formulation

Guide RNAs of the present disclosure can be formulated with pharmaceutically acceptable excipients such as carriers, solvents, stabilizers, adjuvants, diluents, etc., depending upon the particular mode of administration and dosage form. Guide RNA compositions can be formulated to achieve a physiologically compatible pH, and range from a pH of about 3 to a pH of about 11, about pH 3 to about pH 7, depending on the formulation and route of administration. In some cases, the pH can be adjusted to a range from about pH 5.0 to about pH 8. In some cases, the compositions can comprise a therapeutically effective amount of at least one compound as described herein, together with one or more pharmaceutically acceptable excipients. Optionally, the compositions can comprise a combination of the compounds described herein, or can include a second active ingredient useful in the treatment or prevention of bacterial growth (for example and without limitation, anti-bacterial or anti-microbial agents), or can include a combination of reagents of the present disclosure.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients can include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

Administration & Efficacy

The terms "administering," "introducing" and "transplanting" can be used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some aspects described herein, an effective amount of photoreceptor cells or retinal progenitor cells is administered via a systemic route of administration, such as an intraperitoneal or intravenous route.

The terms "administering," "introducing" and "transplanting" can also be used interchangeably in the context of the placement of at least one of a gRNA, sgRNA, and an endonuclease into a subject, by a method or route that results in at least partial localization of the introduced gRNA, sgRNA, and/or endonuclease at a desired site, such as a site of injury or repair, such that a desired effect(s) is produced. The gRNA, sgRNA, and/or endonuclease can be administered by any appropriate route that results in delivery to a desired location in the subject.

The terms "individual," "subject," "host" and "patient" are used interchangeably herein and refer to any subject for whom diagnosis, treatment or therapy is desired. In some aspects, the subject is a mammal. In some aspects, the subject is a human being.

When provided prophylactically, progenitor cells described herein can be administered to a subject in advance of any symptom of autosomal dominant CORD. Accordingly, the prophylactic administration of a progenitor cell population serves to prevent autosomal dominant CORD.

A progenitor cell population being administered according to the methods described herein can comprise allogeneic progenitor cells obtained from one or more donors. Such progenitors can be of any cellular or tissue origin, e.g., liver, muscle, cardiac, etc. "Allogeneic" refers to a progenitor cell or biological samples comprising progenitor cells obtained from one or more different donors of the same species, where the genes at one or more loci are not identical. For example, a photoreceptor or retinal progenitor cell population being administered to a subject can be derived from one more unrelated donor subjects, or from one or more non-identical siblings. In some cases, syngeneic progenitor cell populations can be used, such as those obtained from genetically identical animals, or from identical twins. The progenitor cells can be autologous cells; that is, the progenitor cells are obtained or isolated from a subject and administered to the same subject, i.e., the donor and recipient are the same.

The term "effective amount" refers to the amount of a population of progenitor cells or their progeny needed to prevent or alleviate at least one or more signs or symptoms of autosomal dominant CORD, and relates to a sufficient amount of a composition to provide the desired effect, e.g., to treat a subject having autosomal dominant CORD. The term "therapeutically effective amount" therefore refers to an amount of progenitor cells or a composition comprising progenitor cells that is sufficient to promote a particular effect when administered to a typical subject, such as one who has or is at risk for autosomal dominant CORD. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various aspects described herein, an effective amount of progenitor cells comprises at least $10^2$ progenitor cells, at least $5\times10^2$ progenitor cells, at least $10^3$ progenitor cells, at least $5\times10^3$ progenitor cells, at least $10^4$ progenitor cells, at least $5\times10^4$ progenitor cells, at least $10^5$ progenitor cells, at least $2\times10^5$ progenitor cells, at least $3\times10^5$ progenitor cells, at least $4\times10^5$ progenitor cells, at least $5\times10^5$ progenitor cells, at least $6\times10^5$ progenitor cells, at least $7\times10^5$ progenitor cells, at least $8\times10^5$ progenitor cells, at least $9\times10^5$ progenitor cells, at least $1\times10^6$ progenitor cells, at least $2\times10^6$ progenitor cells, at least $3\times10^6$ progenitor cells, at least $4\times10^6$ progenitor cells, at least $5\times10^6$ progenitor cells, at least $6\times10^6$ progenitor cells, at least $7\times10^6$ progenitor cells, at least $8\times10^6$ progenitor cells, at least $9\times10^6$ progenitor cells, or multiples thereof. The progenitor cells can be derived from one or more donors, or can be obtained from an autologous source. In some examples described herein, the progenitor cells can be expanded in culture prior to administration to a subject in need thereof.

Modest and incremental increases in the levels of functional RetGC1 protein expressed in cells of patients having autosomal dominant CORD can be beneficial for ameliorating one or more symptoms of the disease, for increasing long-term survival, and/or for reducing side effects associated with other treatments. Upon administration of such cells to human patients, the presence of progenitors that are producing increased levels of functional RetGC1 protein is beneficial. In some cases, effective treatment of a subject gives rise to at least about 3%, 5% or 7% functional RetGC1 protein relative to total RetGC1 in the treated subject. In some examples, functional RetGC1 will be at least about 10% of total RetGC1. In some examples, functional RetGC1 protein will be at least about 20% to 30% of total RetGC1 protein. Similarly, the introduction of even relatively limited subpopulations of cells having significantly elevated levels of functional RetGC1 protein can be beneficial in various patients because in some situations normalized cells will have a selective advantage relative to diseased cells. However, even modest levels of progenitors with elevated levels of functional RetGC1 protein can be beneficial for ameliorating one or more aspects of autosomal dominant CORD in patients. In some examples, about 10%, about 20%, about 30%, about 40%, about 50%, about 60%, about 70%, about 80%, about 90% or more of the photoreceptor cells or retinal progenitor cells in patients to whom such cells are administered are producing increased levels of functional RetGC1 protein.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1\times10^4$ cells are delivered to the desired site for a period of time.

In one aspect of the method, the pharmaceutical composition can be administered via a route such as, but not limited to, enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration, which is then covered by a dressing that occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis and spinal.

Modes of administration include injection, infusion, instillation, and/or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some examples, the route is intravenous. For the delivery of cells, administration by injection or infusion can be made.

The cells can be administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of autosomal dominant CORD can be determined by the skilled clinician. However, a treatment is considered "effective treatment," if any one or all of the signs or symptoms of, as but one example, levels of functional autosomal dominant CORD are altered in a beneficial manner (e.g., increased by at least 10%), or other clinically accepted symptoms or markers of disease are improved or ameliorated. Efficacy can also be measured by failure of an individual to worsen as assessed by hospitalization or need for medical interventions (e.g., progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present disclosure can ameliorate one or more symptoms associated with autosomal dominant CORD by increasing, decreasing or altering the amount of functional RetGC1 in the individual. Signs typically associated with autosomal dominant CORD include for example, decreased central vision, color vision defects, photophobia and decreased sensitivity in the central field at early stages, followed by progressive loss in peripheral vision and night blindness at later stages.

Kits

The present disclosure provides kits for carrying out the methods described herein. A kit can include one or more of a genome-targeting nucleic acid, a polynucleotide encoding a genome-targeting nucleic acid, a site-directed polypeptide, a polynucleotide encoding a site-directed polypeptide, and/or any nucleic acid or proteinaceous molecule necessary to carry out the aspects of the methods described herein, or any combination thereof.

A kit can comprise: (1) a vector comprising a nucleotide sequence encoding a genome-targeting nucleic acid, (2) the site-directed polypeptide or a vector comprising a nucleotide sequence encoding the site-directed polypeptide, and (3) a reagent for reconstitution and/or dilution of the vector(s) and or polypeptide.

A kit can comprise: (1) a vector comprising (i) a nucleotide sequence encoding a genome-targeting nucleic acid, and (ii) a nucleotide sequence encoding the site-directed polypeptide; and (2) a reagent for reconstitution and/or dilution of the vector.

In any of the above kits, the kit can comprise a single-molecule guide genome-targeting nucleic acid. In any of the above kits, the kit can comprise a double-molecule genome-targeting nucleic acid. In any of the above kits, the kit can comprise two or more double-molecule guides or single-molecule guides. The kits can comprise a vector that encodes the nucleic acid targeting nucleic acid.

In any of the above kits, the kit can further comprise a polynucleotide to be inserted to effect the desired genetic modification.

Components of a kit can be in separate containers, or combined in a single container.

Any kit described above can further comprise one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. A kit can also comprise one or more components that can be used to facilitate or enhance the on-target binding or the cleavage of DNA by the endonuclease, or improve the specificity of targeting.

In addition to the above-mentioned components, a kit can further comprise instructions for using the components of the kit to practice the methods. The instructions for practicing the methods can be recorded on a suitable recording medium. For example, the instructions can be printed on a substrate, such as paper or plastic, etc. The instructions can be present in the kits as a package insert, in the labeling of the container of the kit or components thereof (i.e., associated with the packaging or sub packaging), etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this case is a kit that comprises a web address where the instructions can be viewed and/or from which the instructions can be downloaded. As with the instructions, this means for obtaining the instructions can be recorded on a suitable substrate.

Additional Therapeutic Approaches

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR-Cas9 nuclease systems. The nuclease platforms vary in difficulty of design, targeting density and mode of action, particularly as the specificity of ZFNs and TALENs is through protein-DNA interactions, while RNA-DNA interactions primarily guide Cas9. Cas9 cleavage also requires an adjacent motif, the PAM, which differs between different CRISPR systems. Cas9 from *Streptococcus pyogenes* cleaves using a NGG PAM, CRISPR from *Neisseria meningitidis* can cleave at sites with PAMs including NNNNGATT, NNNNNGTTT and NNNNGCTT. A number of other Cas9 orthologs target protospacer adjacent to alternative PAMs.

CRISPR endonucleases, such as Cas9, can be used in the methods of the present disclosure. However, the teachings described herein, such as therapeutic target sites, could be applied to other forms of endonucleases, such as ZFNs, TALENs, HEs, or MegaTALs, or using combinations of nulceases. However, in order to apply the teachings of the present disclosure to such endonucleases, one would need to, among other things, engineer proteins directed to the specific target sites.

Additional binding domains can be fused to the Cas9 protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site.

Zinc Finger Nucleases

Zinc finger nucleases (ZFNs) are modular proteins comprised of an engineered zinc finger DNA binding domain linked to the catalytic domain of the type II endonuclease FokI. Because FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect of ZFNs is that they can be readily re-targeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the typical 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other, and not with themselves. Forcing the obligate heterodimer prevents formation of the homodimer. This has greatly enhanced specificity of ZFNs, as well as any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., Proc Natl Acad Sci USA 96(6):2758-63 (1999); Dreier B et al., J Mol Biol. 303(4):489-502 (2000); Liu Q et al., J Biol Chem. 277(6):3850-6 (2002); Dreier et al., J Biol Chem 280(42): 35588-97 (2005); and Dreier et al., J Biol Chem. 276(31): 29466-78 (2001).

Transcription Activator-Like Effector Nucleases (TALENs)

Transcription Activator-Like Effector Nucleases (TALENs) represent another format of modular nucleases whereby, as with ZFNs, an engineered DNA binding domain is linked to the FokI nuclease domain, and a pair of TALENs operates in tandem to achieve targeted DNA cleavage. The major difference from ZFNs is the nature of the DNA binding domain and the associated target DNA sequence recognition properties. The TALEN DNA binding domain derives from TALE proteins, which were originally described in the plant bacterial pathogen *Xanthomonas* sp. TALEs are comprised of tandem arrays of 33-35 amino acid repeats, with each repeat recognizing a single base pair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ile, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefitted from the use of obligate heterodimer variants of the FokI domain to reduce off-target activity.

Additional variants of the FokI domain have been created that are deactivated in their catalytic function. If one half of either a TALEN or a ZFN pair contains an inactive FokI domain, then only single-strand DNA cleavage (nicking) will occur at the target site, rather than a DSB. The outcome is comparable to the use of CRISPR/Cas9/Cpf1 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB, which is prone to NHEJ-mediated mis-repair.

A variety of TALEN-based systems have been described in the art, and modifications thereof are regularly reported; see, e.g., Boch, Science 326(5959):1509-12 (2009); Mak et al., Science 335(6069):716-9 (2012); and Moscou et al., Science 326(5959):1501 (2009). The use of TALENs based on the "Golden Gate" platform, or cloning scheme, has been described by multiple groups; see, e.g., Cermak et al., Nucleic Acids Res. 39(12):e82 (2011); Li et al., Nucleic Acids Res. 39(14):6315-25(2011); Weber et al., PLoS One. 6(2): e16765 (2011); Wang et al., J Genet Genomics 41(6): 339-47, Epub 2014 May 17 (2014); and Cermak T et al., Methods Mol Biol. 1239:133-59 (2015).

Homing Endonucleases

Homing endonucleases (HEs) are sequence-specific endonucleases that have long recognition sequences (14-44 base pairs) and cleave DNA with high specificity—often at sites unique in the genome. There are at least six known families of HEs as classified by their structure, including LAGLIDADG (SEQ ID NO: 5271), GIY-YIG, His-Cis box, H—N—H, PD-(D/E)xK, and Vsr-like that are derived from a broad range of hosts, including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., Glycobiology 24(8): 663-80 (2014); Belfort and Bonocora, Methods Mol Biol. 1123:1-26 (2014); Hafez and Hausner, Genome 55(8):553-69 (2012).

MegaTAL/Tev-mTALEN/MegaTev

As further examples of hybrid nucleases, the MegaTAL platform and Tev-mTALEN platform use a fusion of TALE DNA binding domains and catalytically active HEs, taking advantage of both the tunable DNA binding and specificity of the TALE, as well as the cleavage sequence specificity of the HE; see, e.g., Boissel et al., NAR 42: 2591-2601 (2014); Kleinstiver et al., G3 4:1155-65 (2014); and Boissel and Scharenberg, Methods Mol. Biol. 1239: 171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on a DNA substrate and generate two DSBs with non-compatible cohesive ends; see, e.g., Wolfs et al., NAR 42, 8816-29 (2014). It is anticipated that other combinations of existing nuclease-based approaches will evolve and be useful in achieving the targeted genome modifications described herein.

dCas9-FokI or dCpf1-Fok1 and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create a DSB. The specificity of targeting is driven by a 20 or 24 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated, particularly in the 5' half of the target sequence, effectively reducing the number of bases that drive specificity. One solution to this has been to completely deactivate the Cas9 or Cpf1 catalytic function—retaining only the RNA-guided DNA binding function—and instead fusing a FokI domain to the deactivated Cas9; see, e.g., Tsai et al., Nature Biotech 32: 569-76 (2014); and Guilinger et al., Nature Biotech. 32: 577-82 (2014). Because FokI must dimerize to become catalytically active, two guide RNAs are required to tether two FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-TevI, takes advantage of both the tunable DNA binding and specificity of the TALE, as well as the cleavage sequence specificity of I-TevI, with the expectation that off-target cleavage can be further reduced.

Methods and Compositions of the Invention

Accordingly, the present disclosure relates in particular to the following non-limiting inventions:

In a first method, Method 1, the present disclosure provides a method for editing a GUCY2D gene in a human cell, the method comprising: introducing into the human cell one or more DNA endonucleases to effect one or more SSBs or DSBs within or near the GUCY2D gene or other DNA sequences that encode regulatory elements of the GUCY2D gene that results in a deletion, insertion, or correction thereby creating an edited human cell.

In another method, Method 2, the present disclosure provides a method for editing a R838H, R838C, or R838S mutation in a GUCY2D gene in a human cell, the method comprising: introducing into the human cell one or more DNA endonucleases to effect one or more SSBs or DSBs within or near the R838H, R838C, or R838S mutation in a GUCY2D gene that results in a deletion, insertion, or correction thereby creating an edited human cell.

In another method, Method 3, the present disclosure provides an in vivo method for treating a patient with autosomal dominant CORD, the method comprising: editing a R838H, R838C, or R838S mutation in a GUCY2D gene in a cell of the patient.

In another method, Method 4, the present disclosure provides an in vivo method for treating a patient with autosomal dominant CORD as provided in Method 3, wherein the editing comprises: introducing into the cell one or more DNA endonucleases to effect one or more SSBs or DSBs within or near the R838H, R838C, or R838S mutation in a GUCY2D gene that results in a deletion, insertion, or correction and results in restoration of RetGC1 protein activity.

In another method, Method 5, the present disclosure provides an in vivo method for treating a patient with autosomal dominant CORD as provided in Methods 1-2 or 4, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

In another method, Method 6, the present disclosure provides an in vivo method for treating a patient with autosomal dominant CORD as provided in Method 5, wherein the method comprises introducing into the cell one or more polynucleotides encoding the one or more DNA endonucleases.

In another method, Method 7, the present disclosure provides an in vivo method for treating a patient with autosomal dominant CORD as provided in Method 5, wherein the method comprises introducing into the cell one or more RNAs encoding the one or more DNA endonucleases.

In another method, Method 8, the present disclosure provides an in vivo method for treating a patient with autosomal dominant CORD as provided in Methods 6 or 7, wherein the one or more polynucleotides or one or more RNAs is one or more modified polynucleotides or one or more modified RNAs.

In another method, Method 9, the present disclosure provides an in vivo method for treating a patient with autosomal dominant CORD as provided in Method 5, wherein the DNA endonuclease is one or more proteins or polypeptides.

In another method, Method 10, the present disclosure provides an in vivo method for treating a patient with autosomal dominant CORD as provided in Methods 1-9, wherein the method further comprises: introducing into the cell one or more gRNAs.

In another method, Method 11, the present disclosure provides an in vivo method for treating a patient with autosomal dominant CORD as provided in Method 10, wherein the one or more gRNAs are sgRNAs.

In another method, Method 12, the present disclosure provides an in vivo method for treating a patient with autosomal dominant CORD as provided in Methods 10-11, wherein the one or more gRNAs or one or more sgRNAs is one or more modified gRNAs or one or more modified sgRNAs.

In another method, Method 13, the present disclosure provides an in vivo method for treating a patient with autosomal dominant CORD as provided in Methods 9-11, wherein the one or more DNA endonucleases is pre-complexed with one or more gRNAs or one or more sgRNAs.

In another method, Method 14, the present disclosure provides an in vivo method for treating a patient with autosomal dominant CORD as provided in Methods 1-13, further comprising: introducing into the cell a polynucleotide donor template comprising at least a portion of the wild-type GUCY2D gene, or cDNA.

In another method, Method 15, the present disclosure provides an in vivo method for treating a patient with autosomal dominant CORD as provided in Method 14, wherein the at least a portion of the wild-type GUCY2D gene or cDNA is exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, intronic regions, fragments or combinations thereof, or the entire GUCY2D gene or cDNA.

In another method, Method 16, the present disclosure provides an in vivo method for treating a patient with autosomal dominant CORD as provided in Methods 14-15, wherein the donor template is either a single or double stranded polynucleotide.

In another method, Method 17, the present disclosure provides an in vivo method for treating a patient with autosomal dominant CORD as provided in Methods 14-15, wherein the donor template has homologous arms to the 17p13.1 region.

In another method, Method 18, the present disclosure provides an in vivo method for treating a patient with autosomal dominant CORD as provided in Methods 2 or 4, further comprising: introducing into the cell one gRNA and a polynucleotide donor template comprising at least a portion of the wild-type GUCY2D gene; wherein the one or more DNA endonucleases is one or more Cas9 or Cpf1 endonucleases that effect one SSB or DSB at a locus located within or near the R838H, R838C, or R838S mutation in a GUCY2D gene that facilitates insertion of a new sequence from the polynucleotide donor template into the chromosomal DNA at the locus that results in a insertion or correction of the R838H, R838C, or R838S mutation in a GUCY2D gene; and wherein the gRNA comprises a spacer sequence that is complementary to a segment of the locus located within or near the R838H, R838C, or R838S mutation in a GUCY2D gene.

In another method, Method 19, the present disclosure provides an in vivo method for treating a patient with autosomal dominant CORD as provided in Methods 2 or 4, further comprising: introducing into the cell one or more gRNAs and a polynucleotide donor template comprising at least a portion of the wild-type GUCY2D gene; wherein the one or more DNA endonucleases is one or more Cas9 or Cpf1 endonucleases that effect a pair of SSBs or DSBs, the first at a 5' locus and the second at a 3' locus, within or near the R838H, R838C, or R838S mutation in a GUCY2D gene that facilitates insertion of a new sequence from the polynucleotide donor template into the chromosomal DNA between the 5' locus and the 3' locus that results in a insertion or correction of the chromosomal DNA between the 5' locus and the 3' locus within or near the R838H, R838C, or R838S mutation in a GUCY2D gene; and wherein the first gRNA comprises a spacer sequence that is complementary to a segment of the 5' locus and the second gRNA comprises a spacer sequence that is complementary to a segment of the 3' locus.

In another method, Method 20, the present disclosure provides an in vivo method for treating a patient with autosomal dominant CORD as provided in Methods 18-19, wherein the one or more gRNAs are one or more sgRNAs.

In another method, Method 21, the present disclosure provides an in vivo method for treating a patient with autosomal dominant CORD as provided in Methods 18-20, wherein the one or more gRNAs or one or more sgRNAs is one or more modified gRNAs or one or more modified sgRNAs.

In another method, Method 22, the present disclosure provides an in vivo method for treating a patient with autosomal dominant CORD as provided in Methods 18-21, wherein the one or more DNA endonucleases is pre-complexed with one or more gRNAs or one or more sgRNAs.

In another method, Method 23, the present disclosure provides an in vivo method for treating a patient with autosomal dominant CORD as provided in Methods 18-22, wherein the at least a portion of the wild-type GUCY2D gene or cDNA is exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, intronic regions, fragments or combinations thereof, or the entire GUCY2D gene or cDNA.

In another method, Method 24, the present disclosure provides an in vivo method for treating a patient with autosomal dominant CORD as provided in Methods 18-23, wherein the donor template is either a single or double stranded polynucleotide.

In another method, Method 25, the present disclosure provides an in vivo method for treating a patient with autosomal dominant CORD as provided in Methods 18-24, wherein the donor template has homologous arms to the 17p13.1 region.

In another method, Method 26, the present disclosure provides an in vivo method for treating a patient with autosomal dominant CORD as provided in Methods 18-25, wherein the SSB or DSB are in the first exon, second exon, third exon, fourth exon, fifth exon, sixth exon, seventh exon, eighth exon, ninth exon, tenth exon, eleventh exon, twelfth exon, thirteenth exon, fourteenth exon, fifteenth exon, sixteenth exon, seventeenth exon, eighteenth exon, nineteenth exon, twentieth exon, or combinations thereof of the GUCY2D gene.

In another method, Method 27, the present disclosure provides an in vivo method for treating a patient with autosomal dominant CORD as provided in Methods 10-13 or 20-22, wherein the gRNA or sgRNA is directed to one or more pathological variant: R838H, R838C, or R838S.

In another method, Method 28, the present disclosure provides an in vivo method for treating a patient with autosomal dominant CORD as provided in Methods 1-2 or 4-27, wherein the insertion or correction is by HDR.

In another method, Method 29, the present disclosure provides an in vivo method for treating a patient with autosomal dominant CORD as provided in Methods 18-19, wherein the donor template has homologous arms to a pathological variant R838H, R838C, or R838S.

In another method, Method 30, the present disclosure provides an in vivo method for treating a patient with autosomal dominant CORD as provided in Methods 2 or 4, further comprising: introducing into the cell two gRNAs and a polynucleotide donor template comprising at least a portion of the wild-type GUCY2D gene; wherein the one or more DNA endonucleases is one or more Cas9 or Cpf1 endonucleases that effect a pair of DSBs, the first at a 5' DSB locus and the second at a 3' DSB locus, within or near the R838H, R838C, or R838S mutation in a GUCY2D gene that causes a deletion of the chromosomal DNA between the 5' DSB locus and the 3' DSB locus that results in a deletion of the chromosomal DNA between the 5' DSB locus and the 3' DSB locus within or near the R838H, R838C, or R838S mutation in a GUCY2D gene; and wherein the first guide RNA comprises a spacer sequence that is complementary to a segment of the 5' DSB locus and the second guide RNA comprises a spacer sequence that is complementary to a segment of the 3' DSB locus.

In another method, Method 31, the present disclosure provides an in vivo method for treating a patient with autosomal dominant CORD as provided in Method 30, wherein the two gRNAs are two sgRNAs.

In another method, Method 32, the present disclosure provides an in vivo method for treating a patient with autosomal dominant CORD as provided in Methods 30-31, wherein the two gRNAs or two sgRNAs are two modified gRNAs or two modified sgRNAs.

In another method, Method 33, the present disclosure provides an in vivo method for treating a patient with autosomal dominant CORD as provided in Methods 30-32, wherein the one or more DNA endonucleases is pre-complexed with two gRNAs or two sgRNAs.

In another method, Method 34, the present disclosure provides an in vivo method for treating a patient with autosomal dominant CORD as provided in Methods 30-33, wherein both the 5' DSB and 3' DSB are in or near either the first exon, first intron, second exon, second intron, third exon, third intron, fourth exon, fourth intron, fifth exon, fifth intron, sixth exon, sixth intron, seventh exon, seventh intron, eighth exon, eighth intron, ninth exon, ninth intron, tenth exon, tenth intron, eleventh exon, eleventh intron, twelfth exon, twelfth intron, thirteenth exon, thirteenth intron, fourteenth exon, fourteenth intron, fifteenth exon, fifteenth intron, sixteenth exon, sixteenth intron, seventeenth exon, seventeenth intron, eighteenth exon, eighteenth intron, nineteenth exon, nineteenth intron, twentieth exon, or combinations thereof, of the GUCY2D gene.

In another method, Method 35, the present disclosure provides an in vivo method for treating a patient with autosomal dominant CORD as provided in Methods 30-34, wherein the deletion is a deletion of 1 kb or less.

In another method, Method 36, the present disclosure provides an in vivo method for treating a patient with autosomal dominant CORD as provided in Methods 18-19 and 30, wherein the Cas9 or Cpf1 mRNA, gRNA, and donor template are either each formulated into separate lipid nanoparticles or all co-formulated into a lipid nanoparticle.

In another method, Method 37, the present disclosure provides an in vivo method for treating a patient with autosomal dominant CORD as provided in Methods 18-19 and 30, wherein the Cas9 or Cpf1 mRNA, gRNA, and donor template are either each formulated into separate AAV vectors or all co-formulated into an AAV vector.

In another method, Method 38, the present disclosure provides an in vivo method for treating a patient with autosomal dominant CORD as provided in Methods 18-19 and 30, wherein the Cas9 or Cpf1 mRNA is formulated into a lipid nanoparticle, and both the gRNA and donor template are delivered to the cell by an AAV vector.

In another method, Method 39, the present disclosure provides an in vivo method for treating a patient with autosomal dominant CORD as provided in Methods 18-19 and 30, wherein the Cas9 or Cpf1 mRNA is formulated into a lipid nanoparticle, and the gRNA is delivered to the cell by electroporation and donor template is delivered to the cell by an AAV vector.

In another method, Method 40, the present disclosure provides an in vivo method for treating a patient with autosomal dominant CORD as provided in Methods 37-39, wherein the AAV vector is a self-inactivating AAV vector.

In another method, Method 41, the present disclosure provides an in vivo method for treating a patient with autosomal dominant CORD as provided in Methods 1-40, wherein the GUCY2D gene is located on Chromosome 17: 8,002,594 to 8,020,339 (Genome Reference Consortium—GRCh38/hg38).

In another method, Method 42, the present disclosure provides an in vivo method for treating a patient with autosomal dominant CORD as provided in Methods 2 or 4-41, wherein the restoration of RetGC1 protein activity is compared to wild-type or normal RetGC1 protein activity.

In another method, Method 43, the present disclosure provides a method for editing a GUCY2D gene in a human cell as provided in Methods 1-2, wherein the human cell is a photoreceptor cell or retinal progenitor cell.

In another method, Method 44, the present disclosure provides an in vivo method for treating a patient with autosomal dominant CORD as provided in Methods 3-42, wherein the cell is a photoreceptor cell or retinal progenitor cell.

In another method, Method 45, the present disclosure provides an in vivo method for treating a patient with autosomal dominant CORD as provided in Method 14, wherein the polynucleotide donor template comprises exon 1 of GUCY2D and is up to 5 KB.

In another method, Method 46, the present disclosure provides an in vivo method for treating a patient with autosomal dominant CORD as provided in Method 45, wherein the polynucleotide donor template is delivered by AAV.

In another method, Method 47, the present disclosure provides a method for editing a R838H mutation in a GUCY2D gene in a human cell, the method comprising: introducing into the human cell one or more DNA endonucleases to effect one or more SSBs or DSBs within or near the R838H mutation in a GUCY2D gene that results in a deletion, insertion, correction, or modulation of expression or function of the R838H mutation thereby creating an edited human cell.

In another method, Method 48, the present disclosure provides a method for editing a R838C mutation in a GUCY2D gene in a human cell, the method comprising: introducing into the human cell one or more DNA endonucleases to effect one or more SSBs or DSBs within or near the R838C mutation in a GUCY2D gene that results in a deletion, insertion, correction, or modulation of expression or function of the R838C mutation thereby creating an edited human cell.

In another method, Method 49, the present disclosure provides a method for editing a R838S mutation in a GUCY2D gene in a human cell, the method comprising: introducing into the human cell one or more DNA endonucleases to effect one or more SSBs or DSBs within or near the R838S mutation in a GUCY2D gene that results in a deletion, insertion, correction, or modulation of expression or function of the R838S mutation thereby creating an edited human cell.

In another method, Method 50, the present disclosure provides an in vivo method for treating a patient with autosomal dominant CORD, the method comprising: editing a R838H mutation in a GUCY2D gene in a cell of the patient.

In another method, Method 51, the present disclosure provides an in vivo method for treating a patient with autosomal dominant CORD, the method comprising: editing a R838C mutation in a GUCY2D gene in a cell of the patient.

In another method, Method 52, the present disclosure provides an in vivo method for treating a patient with autosomal dominant CORD, the method comprising: editing a R838S mutation in a GUCY2D gene in a cell of the patient.

In another method, Method 53, the present disclosure provides a method for editing an R838H mutation within a GUCY2D gene, the method comprising administering a gRNA or sgRNA comprising SEQ ID NO: 5285.

In another method, Method 54, the present disclosure provides a method for editing an R838H mutation within a GUCY2D gene, the method comprising administering a gRNA or sgRNA comprising SEQ ID NO: 5286.

In another method, Method 55, the present disclosure provides a method for editing an R838H mutation or R838C mutation within a GUCY2D gene, the method comprising administering a gRNA or sgRNA comprising SEQ ID NO: 5398.

In another method, Method 56, the present disclosure provides a method for editing an R838H mutation within a GUCY2D gene, the method comprising administering a gRNA or sgRNA comprising SEQ ID NO: 5464.

In another method, Method 57, the present disclosure provides a method for editing an R838H mutation within a GUCY2D gene, the method comprising administering a gRNA or sgRNA comprising SEQ ID NO: 5465.

In another method, Method 58, the present disclosure provides a method for editing an R838H mutation or R838C mutation within a GUCY2D gene, the method comprising administering a gRNA or sgRNA comprising SEQ ID NO: 5466.

In another method, Method 59, the present disclosure provides a method for treating a patient with an R838H mutation within a GUCY2D gene, the method comprising administering a gRNA or sgRNA comprising SEQ ID NO: 5285 to the patient.

In another method, Method 60, the present disclosure provides a method for treating a patient with an R838H mutation within a GUCY2D gene, the method comprising administering a gRNA or sgRNA comprising SEQ ID NO: 5286 to the patient.

In another method, Method 61, the present disclosure provides a method for treating a patient with an R838H mutation or R838C mutation within a GUCY2D gene, the method comprising administering a gRNA or sgRNA comprising SEQ ID NO: 5398 to the patient.

In another method, Method 62, the present disclosure provides a method for treating a patient with an R838H mutation within a GUCY2D gene, the method comprising administering a gRNA or sgRNA comprising SEQ ID NO: 5464 to the patient.

In another method, Method 63, the present disclosure provides a method for treating a patient with an R838H mutation within a GUCY2D gene, the method comprising administering a gRNA or sgRNA comprising SEQ ID NO: 5465 to the patient.

In another method, Method 64, the present disclosure provides a method for treating a patient with an R838H mutation or R838C mutation within a GUCY2D gene, the method comprising administering a gRNA or sgRNA comprising SEQ ID NO: 5466 to the patient.

In another method, Method 65, the present disclosure provides a method for editing an R838H mutation or R838C mutation within a GUCY2D gene, the method comprising administering the self-inactivating CRISPR-Cas system of any of Self-inactivating CRISPR-Cas systems 1-35.

In another method, Method 66, the present disclosure provides a method for treating a patient with an R838H mutation or R838C mutation within a GUCY2D gene, the method comprising administering the self-inactivating CRISPR-Cas system of any of Self-inactivating CRISPR-Cas systems 1-35.

In another method, Method 67, the present disclosure provides a method of controlling Cas9 expression in a cell comprising: contacting the cell with the self-inactivating CRISPR-Cas system of any of Self-inactivating CRISPR-Cas systems 1-35.

In another method, Method 68, the present disclosure provides a method for editing a GUCY2D gene in a human cell as provided in Method 1, wherein the human cell has defective activity and the edited human cell expresses a functional GUCY2D.

In another method, Method 69, the present disclosure provides a method for editing a R838H, R838C, or R838S mutation in a GUCY2D gene in a human cell as provided in Method 2, wherein the human cell has defective activity and the edited human cell expresses a functional GUCY2D.

In another method, Method 70, the present disclosure provides a method for editing a R838H mutation in a GUCY2D gene in a human cell as provided in Method 47, wherein the human cell has defective activity and the edited human cell expresses a functional GUCY2D.

In another method, Method 71, the present disclosure provides a method for editing a R838C mutation in a GUCY2D gene in a human cell as provided in Method 48, wherein the human cell has defective activity and the edited human cell expresses a functional GUCY2D.

In another method, Method 72, the present disclosure provides a method for editing a R838S mutation in a GUCY2D gene in a human cell as provided in Method 49, wherein the human cell has defective activity and the edited human cell expresses a functional GUCY2D.

In another method, Method 73, the present disclosure provides a method for editing a GUCY2D gene in a human cell as provided in Method 1, wherein the deletion, insertion, or correction results in a modulation of expression or function of the GUCY2D gene.

In another method, Method 74, the present disclosure provides a method for editing a R838H, R838C, or R838S mutation in a GUCY2D gene in a human cell as provided in Method 2, wherein the deletion, insertion, or correction results in a modulation of expression or function of the GUCY2D gene.

In another method, Method 75, the present disclosure provides an in vivo method for treating a patient with autosomal dominant CORD as provided in Method 4, wherein the deletion, insertion, or correction results in a modulation of expression or function of the GUCY2D gene and results in restoration of retinal membrane guanylate cyclase-1 (RetGC1) protein activity.

In another method, Method 76, the present disclosure provides an in vivo method for treating a patient with autosomal dominant CORD as provided in Method 3, wherein the editing comprises: introducing into the cell one or more DNA endonucleases to effect one or more SSBs or DSBs within or near the R838H, R838C, or R838S mutation in a GUCY2D gene that results in a modulation of expression or function of the GUCY2D gene and results in restoration of retinal membrane guanylate cyclase-1 (RetGC1) protein activity.

In another method, Method 77, the present disclosure provides a method for editing a GUCY2D gene in a human cell, the method comprising: introducing into the human cell one or more deoxyribonucleic acid (DNA) endonucleases to effect one or more single-strand breaks (SSBs) or double-strand breaks (DSBs) within or near the GUCY2D gene or other DNA sequences that encode regulatory elements of the GUCY2D gene that results in a modulation of expression or function of the GUCY2D gene thereby creating an edited human cell.

In another method, Method 78, the present disclosure provides a method for editing a R838H, R838C, or R838S mutation in a GUCY2D gene in a human cell, the method comprising: introducing into the human cell one or more DNA endonucleases to effect one or more SSBs or DSBs within or near the R838H, R838C, or R838S mutation in a GUCY2D gene that results in a modulation of expression or function of the GUCY2D gene thereby creating an edited human cell.

In another method, Method 79, the present disclosure provides a method for editing a R838H mutation in a GUCY2D gene in a human cell, the method comprising: introducing into the human cell one or more DNA endonucleases to effect one or more SSBs or DSBs within or near the R838H mutation in a GUCY2D gene that results in a deletion, insertion, or correction thereby creating an edited human cell.

In another method, Method 80, the present disclosure provides a method for editing a R838H mutation in a GUCY2D gene in a human cell, the method comprising: introducing into the human cell one or more DNA endonucleases to effect one or more SSBs or DSBs within or near the R838H mutation in a GUCY2D gene that results in a modulation of expression or function thereby creating an edited human cell.

In another method, Method 81, the present disclosure provides a method for editing a R838C mutation in a GUCY2D gene in a human cell, the method comprising: introducing into the human cell one or more DNA endonucleases to effect one or more SSBs or DSBs within or near the R838C mutation in a GUCY2D gene that results in a deletion, insertion, or correction thereby creating an edited human cell.

In another method, Method 82, the present disclosure provides a method for editing a R838C mutation in a GUCY2D gene in a human cell, the method comprising: introducing into the human cell one or more DNA endonucleases to effect one or more SSBs or DSBs within or near the R838C mutation in a GUCY2D gene that results in a modulation of expression or function thereby creating an edited human cell.

In another method, Method 83, the present disclosure provides a method for editing a R838S mutation in a GUCY2D gene in a human cell, the method comprising: introducing into the human cell one or more DNA endonucleases to effect one or more SSBs or DSBs within or near the R838S mutation in a GUCY2D gene that results in a deletion, insertion, or correction thereby creating an edited human cell.

In another method, Method 84, the present disclosure provides a method for editing a R838S mutation in a GUCY2D gene in a human cell, the method comprising: introducing into the human cell one or more DNA endonucleases to effect one or more SSBs or DSBs within or near the R838S mutation in a GUCY2D gene that results in a modulation of expression or function thereby creating an edited human cell.

In a first composition, Composition 1, the present disclosure provides one or more gRNAs for editing a R838H, R838C, or R838S mutation in a GUCY2D gene in a cell from a patient with autosomal dominant CORD, the one or more gRNAs comprising a spacer sequence selected from the group consisting of nucleic acid sequences in SEQ ID NOs: 5282-5313, 5398-5409, and 5434-5443 of the Sequence Listing.

In another composition, Composition 2, the present disclosure provides the one or more gRNAs of Composition 1, wherein the one or more gRNAs are one or more sgRNAs.

In another composition, Composition 3, the present disclosure provides the one or more gRNAs of Compositions 1 or 2, wherein the one or more gRNAs or one or more sgRNAs is one or more modified gRNAs or one or more modified sgRNAs.

In another composition, Composition 4, the present disclosure provides the one or more gRNAs of Compositions 1-3, wherein the cell is a photoreceptor cell, retinal progenitor cell, or induced pluripotent stem cell (iPSC).

In another composition, Composition 5, the present disclosure provides one or more gRNAs for editing a R838H mutation in a GUCY2D gene in a cell from a patient with autosomal dominant CORD, the one or more gRNAs comprising a spacer sequence selected from the group consisting of nucleic acid sequences in SEQ ID NOs: 5282-5293, 5398-5409, and 5434-5443 of the Sequence Listing.

In another composition, Composition 6, the present disclosure provides one or more gRNAs for editing a R838C mutation in a GUCY2D gene in a cell from a patient with autosomal dominant CORD, the one or more gRNAs comprising a spacer sequence selected from the group consisting of nucleic acid sequences in SEQ ID NOs: 5294-5303 and 5398-5409 of the Sequence Listing.

In another composition, Composition 7, the present disclosure provides one or more gRNAs for editing a R838S mutation in a GUCY2D gene in a cell from a patient with autosomal dominant CORD, the one or more gRNAs comprising a spacer sequence selected from the group consisting of nucleic acid sequences in SEQ ID NOs: 5304-5313 and 5434-5443 of the Sequence Listing.

In another composition, Composition 8, the present disclosure provides a gRNA for editing a R838H or R838C mutation in a GUCY2D gene in a cell from a patient with autosomal dominant CORD, the gRNA comprising a spacer sequence selected from the group consisting of nucleic acid sequences in SEQ ID NOs: 5398-5409 of the Sequence Listing.

In another composition, Composition 9, the present disclosure provides the gRNA of Composition 8, wherein the gRNA is a sgRNA.

In another composition, Composition 10, the present disclosure provides the gRNA or sgRNA of Compositions 8 or 9, wherein the gRNA or sgRNA is a modified gRNA or modified sgRNA.

In another composition, Composition 11, the present disclosure provides the gRNA or sgRNA of Compositions 8-10, wherein the cell is a photoreceptor cell, retinal progenitor cell, or induced pluripotent stem cell (iPSC).

In another composition, Composition 12, the present disclosure provides a gRNA for editing a R838H or R838S mutation in a GUCY2D gene in a cell from a patient with autosomal dominant CORD, the gRNA comprising a spacer sequence selected from the group consisting of nucleic acid sequences in SEQ ID NOs: 5434-5443 of the Sequence Listing.

In another composition, Composition 13, the present disclosure provides the gRNA of Composition 12, wherein the gRNA is a sgRNA.

In another composition, Composition 14, the present disclosure provides the gRNA or sgRNA of Compositions 12 or 13, wherein the gRNA or sgRNA is a modified gRNA or modified sgRNA.

In another composition, Composition 15, the present disclosure provides the gRNA or sgRNA of Compositions 12-14, wherein the cell is a photoreceptor cell, retinal progenitor cell, or induced pluripotent stem cell (iPSC).

In another composition, Composition 16, the present disclosure provides a single-molecule guide RNA (sgRNA) for editing a R838H mutation in a GUCY2D gene in a cell from a patient with autosomal dominant CORD, the sgRNA comprising the nucleic acid sequence of SEQ ID NO: 5285.

In another composition, Composition 17, the present disclosure provides a single-molecule guide RNA (sgRNA) for editing a R838H or R838C mutation in a GUCY2D gene in a cell from a patient with autosomal dominant CORD, the sgRNA comprising the nucleic acid sequence of SEQ ID NO: 5398.

In another composition, Composition 18, the present disclosure provides a single-molecule guide RNA (sgRNA) for editing a R838H mutation in a GUCY2D gene in a cell from a patient with autosomal dominant CORD, the sgRNA comprising the nucleic acid sequence of SEQ ID NO: 5286.

In another composition, Composition 19, the present disclosure provides a single-molecule guide RNA (sgRNA) for editing a R838H mutation in a GUCY2D gene in a cell from a patient with autosomal dominant CORD, the sgRNA comprising the nucleic acid sequence of SEQ ID NO: 5464.

In another composition, Composition 20, the present disclosure provides a single-molecule guide RNA (sgRNA) for editing a R838H mutation in a GUCY2D gene in a cell from a patient with autosomal dominant CORD, the sgRNA comprising the nucleic acid sequence of SEQ ID NO: 5465.

In another composition, Composition 21, the present disclosure provides a single-molecule guide RNA (sgRNA) for editing a R838H or R838C mutation in a GUCY2D gene in a cell from a patient with autosomal dominant CORD, the sgRNA comprising the nucleic acid sequence of SEQ ID NO: 5466.

In another composition, Composition 22, the present disclosure provides one or more gRNAs for editing a R838H, R838C, or R838S mutation in a GUCY2D gene, the one or more gRNAs comprising a spacer sequence selected from the group consisting of nucleic acid sequences in SEQ ID NOs: 5282-5313, 5398-5409, and 5434-5443 of the Sequence Listing.

In a first therapeutic, Therapeutic 1, the present disclosure provides a therapeutic for treating a patient with autosomal dominant Cone-Rod Dystrophy, the therapeutic comprising at least one or more gRNAs for editing a R838H, R838C, or R838S mutation in a GUCY2D gene, the one or more gRNAs comprising a spacer sequence selected from the group consisting of nucleic acid sequences in SEQ ID NOs: 5282-5313, 5398-5409, and 5434-5443 of the Sequence Listing.

In another therapeutic, Therapeutic 2, the present disclosure provides the therapeutic of Therapeutic 2, wherein the one or more gRNAs are one or more sgRNAs.

In another therapeutic, Therapeutic 3, the present disclosure provides the therapeutic of Therapeutics 1 or 2, wherein the one or more gRNAs or one or more sgRNAs is one or more modified gRNAs or one or more modified sgRNAs.

In another therapeutic, Therapeutic 4, the present disclosure provides a therapeutic for treating a patient with autosomal dominant CORD, the therapeutic formed by a method comprising: introducing one or more DNA endonucleases; introducing one or more gRNA or one or more sgRNA for editing a R838H, R838C, or R838S mutation in a GUCY2D gene; and optionally introducing one or more donor template; wherein the one or more gRNAs or sgRNAs comprise a spacer sequence selected from the group consisting of nucleic acid sequences in SEQ ID NOs: 5282-5313, 5398-5409, and 5434-5443 of the Sequence Listing.

In another therapeutic, Therapeutic 5, the present disclosure provides a therapeutic comprising at least one or more gRNAs for editing a R838H mutation in a GUCY2D gene, the one or more gRNAs comprising a spacer sequence selected from the group consisting of nucleic acid sequences in SEQ ID NOs: 5282-5293, 5398-5409, and 5434-5443 of the Sequence Listing.

In another therapeutic, Therapeutic 6, the present disclosure provides a therapeutic comprising at least one or more gRNAs for editing a R838C mutation in a GUCY2D gene, the one or more gRNAs comprising a spacer sequence selected from the group consisting of nucleic acid sequences in SEQ ID NOs: 5294-5303 and 5398-5409 of the Sequence Listing.

In another therapeutic, Therapeutic 7, the present disclosure provides a therapeutic comprising at least one or more gRNAs for editing a R838S mutation in a GUCY2D gene, the one or more gRNAs comprising a spacer sequence selected from the group consisting of nucleic acid sequences in SEQ ID NOs: 5304-5313 and 5434-5443 of the Sequence Listing.

In another therapeutic, Therapeutic 8, the present disclosure provides a therapeutic for treating a patient with autosomal dominant CORD, formed by a method comprising: introducing one or more DNA endonucleases; introducing one or more gRNA or one or more sgRNA for editing a R838H mutation in a GUCY2D gene; and optionally introducing one or more donor template; wherein the one or more gRNAs or sgRNAs comprise a spacer sequence selected from the group consisting of nucleic acid sequences in SEQ ID NOs: 5282-5293, 5398-5409, and 5434-5443 of the Sequence Listing.

In another therapeutic, Therapeutic 9, the present disclosure provides a therapeutic for treating a patient with autosomal dominant CORD, formed by a method comprising: introducing one or more DNA endonucleases; introducing one or more gRNA or one or more sgRNA for editing a R838C mutation in a GUCY2D gene; and optionally introducing one or more donor template; wherein the one or more gRNAs or sgRNAs comprise a spacer sequence selected from the group consisting of nucleic acid sequences in SEQ ID NOs: 5294-5303 and 5398-5409 of the sequence listing.

In another therapeutic, Therapeutic 10, the present disclosure provides a therapeutic for treating a patient with autosomal dominant CORD, formed by a method comprising: introducing one or more DNA endonucleases; introducing one or more gRNA or one or more sgRNA for editing a R838S mutation in a GUCY2D gene; and optionally introducing one or more donor template; wherein the one or more gRNAs or sgRNAs comprise a spacer sequence selected from the group consisting of nucleic acid sequences in SEQ ID NOs: 5304-5313 and 5434-5443 of the Sequence Listing.

In another therapeutic, Therapeutic 11, the present disclosure provides a therapeutic comprising a gRNA for editing a R838H or R838C mutation in a GUCY2D gene, the gRNA comprising a spacer sequence selected from the group consisting of nucleic acid sequences in SEQ ID NOs: 5398-5409 of the Sequence Listing.

In another therapeutic, Therapeutic 12, the present disclosure provides the therapeutic of Therapeutic 11, wherein the gRNA is a sgRNA.

In another therapeutic, Therapeutic 13, the present disclosure provides the therapeutic of Therapeutics 11 or 12, wherein the gRNA or sgRNA is a modified gRNA or modified sgRNA.

In another therapeutic, Therapeutic 14, the present disclosure provides a therapeutic for treating a patient with autosomal dominant CORD, formed by the method comprising: introducing one or more DNA endonucleases; introducing a gRNA or sgRNA for editing a R838H or R838C mutation in a GUCY2D gene; and introducing one or more donor template; wherein the gRNA or sgRNA comprise a spacer sequence selected from the group consisting of nucleic acid sequences in SEQ ID NOs: 5398-5409 of the Sequence Listing.

In another therapeutic, Therapeutic 15, the present disclosure provides a therapeutic comprising a gRNA for editing a R838H or R838S mutation in a GUCY2D gene, the gRNA comprising a spacer sequence selected from the group consisting of nucleic acid sequences in SEQ ID NOs: 5434-5443 of the Sequence Listing.

In another therapeutic, Therapeutic 16, the present disclosure provides the therapeutic of Therapeutic 15, wherein the gRNA is a sgRNA.

In another therapeutic, Therapeutic 17, the present disclosure provides the therapeutic of Therapeutics 15 or 16, wherein the gRNA or sgRNA is a modified gRNA or modified sgRNA.

In another therapeutic, Therapeutic 18, the present disclosure provides a therapeutic for treating a patient with autosomal dominant CORD, formed by the method comprising: introducing one or more DNA endonucleases; introducing a gRNA or sgRNA for editing a R838H or R838S mutation in a GUCY2D gene; and introducing one or more donor template; wherein the gRNA or sgRNA comprise a spacer sequence selected from the group consisting of nucleic acid sequences in SEQ ID NOs: 5434-5443 of the Sequence Listing.

In another therapeutic, Therapeutic 19, the present disclosure provides a therapeutic comprising the self-inactivating CRISPR-Cas system of any of Self-inactivating CRISPR-Cas systems 1-35.

In another therapeutic, Therapeutic 20, the present disclosure provides the therapeutic of Therapeutic 19, wherein the therapeutic is sterile.

In a first kit, Kit 1, the present disclosure provides a kit for treating a patient with autosomal dominant CORD in vivo, the kit comprising one or more gRNAs or sgRNAs for editing a R838H, R838C, or R838S mutation in a GUCY2D gene wherein the one or more gRNAs or sgRNAs comprise a spacer sequence selected from the group consisting of nucleic acid sequences in SEQ ID NOs: 5282-5313, 5398-

5409, and 5434-5443 of the Sequence Listing; one or more DNA endonucleases; and optionally, one or more donor template.

In another kit, Kit 2, the present disclosure provides the kit of Kit 1, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

In another kit, Kit 3, the present disclosure provides the kit of Kits 1 or 2, comprising one or more donor template.

In another kit, Kit 4, the present disclosure provides the kit of Kit 3, wherein the donor template has homologous arms to the 17p13.1 region.

In another kit, Kit 5, the present disclosure provides the kit of Kit 3, wherein the donor template has homologous arms to a pathological variant R838H, R838C, or R838S.

In another kit, Kit 6, the present disclosure provides a kit for treating a patient with autosomal dominant CORD in vivo, the kit comprising one or more gRNAs or sgRNAs for editing a R838H mutation in a GUCY2D gene wherein the one or more gRNAs or sgRNAs comprise a spacer sequence selected from the group consisting of nucleic acid sequences in SEQ ID NOs: 5282-5293, 5398-5409, and 5434-5443 of the Sequence Listing; one or more DNA endonucleases; and optionally, one or more donor template.

In another kit, Kit 7, the present disclosure provides a kit for treating a patient with autosomal dominant CORD in vivo, the kit comprising one or more gRNAs or sgRNAs for editing a R838C mutation in a GUCY2D gene wherein the one or more gRNAs or sgRNAs comprise a spacer sequence selected from the group consisting of nucleic acid sequences in SEQ ID NOs: 5294-5303 and 5398-5409 of the Sequence Listing; one or more DNA endonucleases; and optionally, one or more donor template.

In another kit, Kit 8, the present disclosure provides a kit for treating a patient with autosomal dominant CORD in vivo, the kit comprising one or more gRNAs or sgRNAs for editing a R838S mutation in a GUCY2D gene wherein the one or more gRNAs or sgRNAs comprise a spacer sequence selected from the group consisting of nucleic acid sequences in SEQ ID NOs: 5304-5313 and 5434-5443 of the Sequence Listing; one or more DNA endonucleases; and optionally, one or more donor template.

In another kit, Kit 9, the present disclosure provides a kit for treating a patient with autosomal dominant CORD in vivo, the kit comprising a gRNA or sgRNA for editing a R838H or R838C mutation in a GUCY2D gene, wherein the gRNA or sgRNA comprise a spacer sequence selected from the group consisting of nucleic acid sequences in SEQ ID NOs: 5398-5409 of the Sequence Listing; one or more DNA endonucleases; and optionally, one or more donor template.

In another kit, Kit 10, the present disclosure provides the kit of Kit 9, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

In another kit, Kit 11, the present disclosure provides the kit of Kits 9 or 10, comprising one or more donor template.

In another kit, Kit 12, the present disclosure provides the kit of Kit 11, wherein the donor template has homologous arms to the 17p13.1 region.

In another kit, Kit 13, the present disclosure provides the kit of Kit 11, wherein the donor template has homologous arms to a pathological variant R838H or R838C.

In another kit, Kit 14, the present disclosure provides a kit for treating a patient with autosomal dominant CORD in vivo, the kit comprising a gRNA or sgRNA for editing a R838H or R838S mutation in a GUCY2D gene, wherein the gRNA or sgRNA comprise a spacer sequence selected from the group consisting of nucleic acid sequences in SEQ ID NOs: 5434-5443 of the Sequence Listing; one or more DNA endonucleases; and optionally, one or more donor template.

In another kit, Kit 15, the present disclosure provides the kit of Kit 14, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

In another kit, Kit 16, the present disclosure provides the kit of Kits 14 or 15, comprising one or more donor template.

In another kit, Kit 17, the present disclosure provides the kit of Kit 16, wherein the donor template has homologous arms to the 17p13.1 region.

In another kit, Kit 18, the present disclosure provides the kit of Kit 16, wherein the donor template has homologous arms to a pathological variant R838H or R838S.

In another kit, Kit 19, the present disclosure provides a kit for treating a patient with autosomal dominant CORD in vivo, the kit comprising: any one of Self-inactivating CRISPR-Cas systems 1-35; and optionally, one or more donor template.

In another kit, Kit 20, the present disclosure provides the kit of Kit 19, comprising one or more donor template.

In another kit, Kit 21, the present disclosure provides the kit of Kit 20, wherein the donor template has homologous arms to the 17p13.1 region.

In another kit, Kit 22, the present disclosure provides the kit of Kit 20, wherein the donor template has homologous arms to a pathological variant R838H, R838C, or R838S.

In a first self-inactivating CRISPR-Cas system, Self-inactivating CRISPR-Cas system 1, the present disclosure provides a self-inactivating CRISPR-Cas system comprising: a first segment comprising a nucleotide sequence that encodes a polypeptide inducing site-directed mutagenesis; a second segment comprising a nucleotide sequence that encodes a guide RNA (gRNA) or a single-molecule guide RNA (sgRNA) wherein the gRNA or sgRNA comprise SEQ ID NO: 5285 or 5464; and one or more third segments comprising a self-inactivating (SIN) site; wherein the gRNA or sgRNA is substantially complementary to the SIN site; wherein the gRNA or sgRNA is substantially complementary to a genomic target sequence.

In another self-inactivating CRISPR-Cas system, Self-inactivating CRISPR-Cas system 2, the present disclosure provides a self-inactivating CRISPR-Cas system comprising a first segment comprising a nucleotide sequence that encodes a polypeptide inducing site-directed mutagenesis; a second segment comprising a nucleotide sequence that encodes a guide RNA (gRNA) or single-molecule guide RNA (sgRNA) wherein the gRNA or sgRNA comprise SEQ ID NO: 5398 or 5466; and one or more third segments comprising a self-inactivating (SIN) site; wherein the gRNA or sgRNA is substantially complementary to the SIN site; wherein the gRNA or sgRNA is substantially complementary to a genomic target sequence.

In another self-inactivating CRISPR-Cas system, Self-inactivating CRISPR-Cas system 3, the present disclosure provides the self-inactivating CRISPR-Cas system of Self-inactivating CRISPR-Cas systems 1 or 2, wherein the polypeptide inducing site-directed mutagenesis is *Streptococcus pyogenes* Cas9 (SpCas9) or any variants thereof.

In another self-inactivating CRISPR-Cas system, Self-inactivating CRISPR-Cas system 4, the present disclosure provides the self-inactivating CRISPR-Cas system of Self-inactivating CRISPR-Cas systems 1-3, wherein the polypeptide inducing site-directed mutagenesis is SpCas9 or any variants thereof; and wherein the SIN site is a 5' SIN site located 5' of a SpCas9 open reading frame (ORF) or a 3' SIN site located 3' of the SpCas9 ORF.

In another self-inactivating CRISPR-Cas system, Self-inactivating CRISPR-Cas system 5, the present disclosure provides the self-inactivating CRISPR-Cas system of Self-inactivating CRISPR-Cas system 4, wherein the 5' SIN site comprises SEQ ID NO: 5327.

In another self-inactivating CRISPR-Cas system, Self-inactivating CRISPR-Cas system 6, the present disclosure provides the self-inactivating CRISPR-Cas system of Self-inactivating CRISPR-Cas systems 4-5, wherein the 3' SIN site comprises SEQ ID NO: 5369.

In another self-inactivating CRISPR-Cas system, Self-inactivating CRISPR-Cas system 7, the present disclosure provides the self-inactivating CRISPR-Cas system of Self-inactivating CRISPR-Cas system 4, wherein the 5' SIN site comprises SEQ ID NO: 5326.

In another self-inactivating CRISPR-Cas system, Self-inactivating CRISPR-Cas system 8, the present disclosure provides the self-inactivating CRISPR-Cas system of Self-inactivating CRISPR-Cas systems 4 and 7, wherein the 3' SIN site comprises SEQ ID NO: 5368.

In another self-inactivating CRISPR-Cas system, Self-inactivating CRISPR-Cas system 9, the present disclosure provides the self-inactivating CRISPR-Cas system of Self-inactivating CRISPR-Cas systems 4-5 and 7, wherein the 5' SIN site is located upstream of the Cas9 open reading frame (ORF) and downstream of a SV40 nuclear localization signal (NLS).

In another self-inactivating CRISPR-Cas system, Self-inactivating CRISPR-Cas system 10, the present disclosure provides the self-inactivating CRISPR-Cas system of Self-inactivating CRISPR-Cas systems 4-5 and 7, wherein the 5' SIN site is located upstream of the Cas9 open reading frame (ORF) and upstream of a SV40 nuclear localization signal (NLS) within a 5' untranslated region (UTR).

In another self-inactivating CRISPR-Cas system, Self-inactivating CRISPR-Cas system 11, the present disclosure provides the self-inactivating CRISPR-Cas system of Self-inactivating CRISPR-Cas systems 1-10, where the SIN site comprises a protospacer adjacent motif (PAM).

In another self-inactivating CRISPR-Cas system, Self-inactivating CRISPR-Cas system 12, the present disclosure provides the self-inactivating CRISPR-Cas system of Self-inactivating CRISPR-Cas system 11, wherein the PAM is NRG or any variants thereof.

In another self-inactivating CRISPR-Cas system, Self-inactivating CRISPR-Cas system 13, the present disclosure provides the self-inactivating CRISPR-Cas system of Self-inactivating CRISPR-Cas systems 1-12, wherein the genomic target sequence is a R838H mutation or R838C mutation in a guanylate cyclase 2D (GUCY2D) gene.

In another self-inactivating CRISPR-Cas system, Self-inactivating CRISPR-Cas system 14, the present disclosure provides the self-inactivating CRISPR-Cas system of Self-inactivating CRISPR-Cas systems 1-13, wherein the first segment comprising a nucleotide sequence that encodes a polypeptide inducing site-directed mutagenesis, further comprises a start codon, a stop codon, and a poly(A) termination site.

In another self-inactivating CRISPR-Cas system, Self-inactivating CRISPR-Cas system 15, the present disclosure provides the self-inactivating CRISPR-Cas system of Self-inactivating CRISPR-Cas systems 1-14, wherein the first segment and the third segment are provided together in a first vector and the second segment is provided in a second vector.

In another self-inactivating CRISPR-Cas system, Self-inactivating CRISPR-Cas system 16, the present disclosure provides the self-inactivating CRISPR-Cas system of Self-inactivating CRISPR-Cas systems 1-14, wherein the first segment, second segment, and third segment are provided together in a vector.

In another self-inactivating CRISPR-Cas system, Self-inactivating CRISPR-Cas system 17, the present disclosure provides the self-inactivating CRISPR-Cas system of Self-inactivating CRISPR-Cas systems 15-16, wherein the third segment is present in the first or second vector at a location 5' of the first segment.

In another self-inactivating CRISPR-Cas system, Self-inactivating CRISPR-Cas system 18, the present disclosure provides the self-inactivating CRISPR-Cas system of Self-inactivating CRISPR-Cas systems 15-16, wherein the third segment is present in the first or second vector at a location 3' of the first segment.

In another self-inactivating CRISPR-Cas system, Self-inactivating CRISPR-Cas system 19, the present disclosure provides the self-inactivating CRISPR-Cas system of Self-inactivating CRISPR-Cas systems 15-16, wherein the one or more third segments are present in the first or second vector at the 5' and 3' ends of the first segment.

In another self-inactivating CRISPR-Cas system, Self-inactivating CRISPR-Cas system 20, the present disclosure provides the self-inactivating CRISPR-Cas system of Self-inactivating CRISPR-Cas system 15, wherein the first vector comprises SEQ ID NO: 5508 and the second vector comprises SEQ ID NO: 5506.

In another self-inactivating CRISPR-Cas system, Self-inactivating CRISPR-Cas system 21, the present disclosure provides the self-inactivating CRISPR-Cas system of Self-inactivating CRISPR-Cas system 15, wherein the first vector comprises SEQ ID NO: 5508 and the second vector comprises SEQ ID NO: 5507.

In another self-inactivating CRISPR-Cas system, Self-inactivating CRISPR-Cas system 22, the present disclosure provides the self-inactivating CRISPR-Cas system of Self-inactivating CRISPR-Cas system 15, wherein the first vector comprises SEQ ID NO: 5509 and the second vector comprises SEQ ID NO: 5506.

In another self-inactivating CRISPR-Cas system, Self-inactivating CRISPR-Cas system 23, the present disclosure provides the self-inactivating CRISPR-Cas system of Self-inactivating CRISPR-Cas system 15, wherein the first vector comprises SEQ ID NO: 5509 and the second vector comprises SEQ ID NO: 5507.

In another self-inactivating CRISPR-Cas system, Self-inactivating CRISPR-Cas system 24, the present disclosure provides the self-inactivating CRISPR-Cas system of Self-inactivating CRISPR-Cas systems 1-23, wherein the third segment is less than 100 nucleotides in length.

In another self-inactivating CRISPR-Cas system, Self-inactivating CRISPR-Cas system 25, the present disclosure provides the self-inactivating CRISPR-Cas system of Self-inactivating CRISPR-Cas system 24, wherein the third segment is less than 50 nucleotides in length.

In another self-inactivating CRISPR-Cas system, Self-inactivating CRISPR-Cas system 26, the present disclosure provides the self-inactivating CRISPR-Cas system of Self-inactivating CRISPR-Cas systems 1-25, wherein the gRNA or sgRNA is fully complementary to the nucleotide sequence of the SIN site except for in at least one location.

In another self-inactivating CRISPR-Cas system, Self-inactivating CRISPR-Cas system 27, the present disclosure provides the self-inactivating CRISPR-Cas system of Self-inactivating CRISPR-Cas systems 1-26, wherein the gRNA or sgRNA is fully complementary to the nucleotide sequence of the SIN site except for in at least two locations.

In another self-inactivating CRISPR-Cas system, Self-inactivating CRISPR-Cas system 28, the present disclosure provides the self-inactivating CRISPR-Cas system of Self-inactivating CRISPR-Cas systems 1-27, wherein a nucleic acid sequence encoding a promoter is operably linked to the first segment.

In another self-inactivating CRISPR-Cas system, Self-inactivating CRISPR-Cas system 29, the present disclosure provides the self-inactivating CRISPR-Cas system of Self-inactivating CRISPR-Cas system 28, wherein the promoter is a spatially-restricted promoter, bidirectional promoter driving gRNA or sgRNA in one direction and SpCas9 in the opposite orientation, or an inducible promoter.

In another self-inactivating CRISPR-Cas system, Self-inactivating CRISPR-Cas system 30, the present disclosure provides the self-inactivating CRISPR-Cas system of Self-inactivating CRISPR-Cas system 29, wherein the spatially-restricted promoter is selected from the group consisting of: any tissue or cell type specific promoter, a hepatocyte-specific promoter, a neuron-specific promoter, an adipocyte-specific promoter, a cardiomyocyte-specific promoter, a skeletal muscle-specific promoter, lung progenitor cell specific promoter, a photoreceptor-specific promoter, and a retinal pigment epithelial (RPE) selective promoter.

In another self-inactivating CRISPR-Cas system, Self-inactivating CRISPR-Cas system 31, the present disclosure provides the self-inactivating CRISPR-Cas system of Self-inactivating CRISPR-Cas systems 15-16, wherein the vector is one or more adeno-associated virus (AAV) vectors.

In another self-inactivating CRISPR-Cas system, Self-inactivating CRISPR-Cas system 32, the present disclosure provides the self-inactivating CRISPR-Cas system of Self-inactivating CRISPR-Cas system 31, wherein the adeno-associated virus (AAV) vector is an AAV5 serotype capsid vector.

In another self-inactivating CRISPR-Cas system, Self-inactivating CRISPR-Cas system 33, the present disclosure provides a self-inactivating CRISPR-Cas system comprising: a first segment comprising a nucleotide sequence that encodes a SpCas9 or any variants thereof; a second segment comprising a nucleotide sequence that encodes a guide RNA (gRNA) or a single-molecule guide RNA (sgRNA); and one or more third segments comprising a self-inactivating (SIN) site; wherein the gRNA or sgRNA is substantially complementary to the SIN site; wherein the gRNA or sgRNA is substantially complementary to a genomic target sequence; wherein the SIN site comprises a sequence selected from the group consisting of SEQ ID NOs: 5478-5492.

In another self-inactivating CRISPR-Cas system, Self-inactivating CRISPR-Cas system 34, the present disclosure provides a self-inactivating CRISPR-Cas system comprising: a first segment comprising a nucleotide sequence that encodes a SpCas9 or any variants thereof; a second segment comprising a nucleotide sequence that encodes a guide RNA (gRNA) or a single-molecule guide RNA (sgRNA); and one or more third segments comprising a self-inactivating (SIN) site; wherein the gRNA or sgRNA is substantially complementary to the SIN site; wherein the gRNA or sgRNA is substantially complementary to a genomic target sequence; wherein the SIN site comprises a sequence selected from the group consisting of SEQ ID NOs: 5324-5355, 5410-5421 and 5444-5453 or SEQ ID NOs: 5366-5397, 5422-5433, and 5454-5463.

In another self-inactivating CRISPR-Cas system, Self-Inactivating CRISPR-Cas system 35, the present disclosure provides a self-inactivating CRISPR-Cas system of Self-inactivating CRISPR-Cas system 34, wherein the SIN site comprises a sequence 1, 2, or 3 nucleotides shorter than any one of the sequences selected from the group consisting of SEQ ID NOs: 5324-5355, 5410-5421 and 5444-5453 or SEQ ID NOs: 5366-5397, 5422-5433, and 5454-5463.

In a first genetically modified cell, Genetically Modified Cell 1, the present disclosure provides a genetically modified cell comprising the self-inactivating CRISPR-Cas system of any of Self-inactivating CRISPR-Cas systems 1-35.

In another genetically modified cell, Genetically Modified Cell 2, the present disclosure provides the genetically modified cell of Genetically Modified Cell 1, wherein the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, an invertebrate cell, a vertebrate cell, a fish cell, a frog cell, a bird cell, a mammalian cell, a pig cell, a cow cell, a goat cell, a sheep cell, a rodent cell, a rat cell, a mouse cell, a non-human primate cell, and a human cell.

In a first nucleic acid, Nucleic Acid 1, the present disclosure provides a nucleic acid encoding a gRNA comprising a spacer sequence selected from the group consisting of SEQ ID NOs: 5282-5313, 5398-5409, and 5434-5443.

In another nucleic acid, Nucleic Acid 2, the present disclosure provides the nucleic acid of Nucleic Acid 1, wherein the gRNA is a sgRNA.

In a first vector, Vector 1, the present disclosure provides a vector encoding a gRNA comprising a spacer sequence selected from the group consisting of SEQ ID NOs: 5282-5313, 5398-5409, and 5434-5443.

In another vector, Vector 2, the present disclosure provides the vector of Vector 1, wherein the gRNA is a sgRNA.

In another vector, Vector 3, the present disclosure provides the vector of any one of Vectors 1 or 2, wherein the vector is an AAV.

In another vector, Vector 4, the present disclosure provides the vector of any one of Vectors 1-3, wherein the vector is an AAV5 sertoype capsid vector.

Definitions

In addition to the definitions previously set forth herein, the following definitions are relevant to the present disclosure:

The term "alteration" or "alteration of genetic information" refers to any change in the genome of a cell. In the context of treating genetic disorders, alterations may include, but are not limited to, insertion, deletion and correction.

The term "insertion" refers to an addition of one or more nucleotides in a DNA sequence. Insertions can range from small insertions of a few nucleotides to insertions of large segments such as a cDNA or a gene.

The term "deletion" refers to a loss or removal of one or more nucleotides in a DNA sequence or a loss or removal of the function of a gene. In some cases, a deletion can include, for example, a loss of a few nucleotides, an exon, an intron, a gene segment, or the entire sequence of a gene. In some cases, deletion of a gene refers to the elimination or reduction of the function or expression of a gene or its gene product. This can result from not only a deletion of sequences within or near the gene, but also other events (e.g., insertion, nonsense mutation) that disrupt the expression of the gene.

The term "correction" as used herein, refers to a change of one or more nucleotides of a genome in a cell, whether by insertion, deletion or substitution. Such correction may result in a more favorable genotypic or phenotypic outcome, whether in structure or function, to the genomic site which was corrected. One non-limiting example of a "correction" includes the correction of a mutant or defective sequence to a wild-type sequence which restores structure or function to a gene or its gene product(s). Depending on the nature of the mutation, correction may be achieved via various strategies disclosed herein. In one non-limiting example, a missense mutation may be corrected by replacing the region containing the mutation with its wild-type counterpart. As another example, duplication mutations (e.g., repeat expansions) in a gene may be corrected by removing the extra sequences.

The term "knock-in" refers to an addition of a DNA sequence, or fragment thereof into a genome. Such DNA sequences to be knocked-in may include an entire gene or genes, may include regulatory sequences associated with a gene or any portion or fragment of the foregoing. For example, a cDNA encoding the wild-type protein may be inserted into the genome of a cell carrying a mutant gene. Knock-in strategies need not replace the defective gene, in whole or in part. In some cases, a knock-in strategy may further involve substitution of an existing sequence with the provided sequence, e.g., substitution of a mutant allele with a wild-type copy. On the other hand, the term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant sequence. Finally, the term "knock-down" as used herein refers to reduction in the expression of a gene or its gene product(s). As a result of a gene knock-down, the protein activity or function may be attenuated or the protein levels may be reduced or eliminated.

The term "comprising" or "comprises" is used in reference to compositions, therapeutics, kits, methods, and respective component(s) thereof, that are essential to the present disclosure, yet open to the inclusion of unspecified elements, whether essential or not.

The term "consisting essentially of" refers to those elements required for a given aspect. The term permits the presence of additional elements that do not materially affect the basic and novel or functional characteristic(s) of that aspect of the present disclosure.

The term "consisting of" refers to compositions, therapeutics, kits, methods, and respective components thereof as described herein, which are exclusive of any element not recited in that description of the aspect.

The singular forms "a," "an," and "the" include plural references, unless the context clearly dictates otherwise.

Any numerical range recited in this specification describes all sub-ranges of the same numerical precision (i.e., having the same number of specified digits) subsumed within the recited range. For example, a recited range of "1.0 to 10.0" describes all sub-ranges between (and including) the recited minimum value of 1.0 and the recited maximum value of 10.0, such as, for example, "2.4 to 7.6," even if the range of "2.4 to 7.6" is not expressly recited in the text of the specification. Accordingly, the Applicant reserves the right to amend this specification, including the claims, to expressly recite any sub-range of the same numerical precision subsumed within the ranges expressly recited in this specification. All such ranges are inherently described in this specification such that amending to expressly recite any such sub-ranges will comply with written description, sufficiency of description, and added matter requirements, including the requirements under 35 U.S.C. § 112(a) and Article 123(2) EPC. Also, unless expressly specified or otherwise required by context, all numerical parameters described in this specification (such as those expressing values, ranges, amounts, percentages, and the like) may be read as if prefaced by the word "about," even if the word "about" does not expressly appear before a number. Additionally, numerical parameters described in this specification should be construed in light of the number of reported significant digits, numerical precision, and by applying ordinary rounding techniques. It is also understood that numerical parameters described in this specification will necessarily possess the inherent variability characteristic of the underlying measurement techniques used to determine the numerical value of the parameter.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

The details of one or more aspects of the present disclosure are set forth in the accompanying examples below. Although any materials and methods similar or equivalent to those described herein can be used in the practice or testing of the present disclosure, specific examples of the materials and methods contemplated are now described. Other features, objects and advantages of the present disclosure will be apparent from the description. In the description examples, the singular forms also include the plural unless the context clearly dictates otherwise. Unless defined otherwise, all technical and scientific terms used herein have the same meaning as commonly understood by one of ordinary skill in the art to which this present disclosure belongs. In the case of conflict, the present description will control.

EXAMPLES

The present disclosure will be more fully understood by reference to the following examples, which provide illustrative non-limiting aspects of the invention.

The examples describe the use of the CRISPR system as an illustrative genome editing technique to create defined therapeutic genomic deletions, insertions, or replacements, termed "genomic modifications" herein, within or near the R838H, R838C, or R838S mutation in the GUCY2D gene that lead to a frameshift and silencing of the expression of the mutant gene or correction of the R838H, R838C, or R838S mutation in the genomic locus, or expression at a heterologous locus, that restore RetGC1 protein activity. Introduction of the defined therapeutic modifications represents a novel therapeutic strategy for the potential amelioration of autosomal dominant CORD, as described and illustrated herein.

Example 1—CRISPR/S. Pyogenes(Sp) Cas9 PAM Sites for the R838H Mutation in the GUCY2D Gene To discover target sites for genome editing by SpCas9, the R838H mutation in the GUCY2D gene was scanned for SpCas9 protospacer adjacent motifs (PAMs). The area was scanned for PAMs having the sequence NRG. gRNA spacer sequences (17-24 bps) located immediately upstream of the NRG PAM were then identified. These sequences are candidates for use in editing the gene.

Example 2—CRISPR/S. aureus(Sa) Cas9 PAM Sites for the R838H Mutation in the GUCY2D Gene To discover target sites for genome editing by SaCas9, the R838H mutation in the GUCY2D gene was scanned for SaCas9 PAMs. The area was scanned for PAMs having the sequence NNGRRT. gRNA spacer sequences (17-24 bps) located immediately upstream of the NNGRRT PAM were then identified. These sequences are candidates for use in editing the gene.

Example 3—CRISPR/S. thermophilus(St) Cas9 PAM Sites for the R838H Mutation in the GUCY2D Gene To discover target sites for genome editing by StCas9, the R838H mutation in the GUCY2D gene is scanned for StCas9 PAMs. The area is scanned for PAMs having the sequence NNAGAAW. gRNA spacer sequences (17-24 bps) located immediately upstream of the NNAGAAW PAM are then identified. These sequences are candidates for use in editing the gene.

Example 4—CRISPR/T. denticola(Td) Cas9 PAM Sites for the R838H Mutation in the GUCY2D Gene To discover target sites for genome editing by TdCas9, the R838H mutation in the GUCY2D gene is scanned for TdCas9 PAMs. The area is scanned for PAMs having the sequence NAAAAC. gRNA spacer sequences (17-24 bps) located immediately upstream of the NAAAAC PAM are then identified. These sequences are candidates for use in editing the gene.

Example 5—CRISPR/N. meningitides(Nm) Cas9 PAM Sites for the R838H Mutation in the GUCY2D Gene To discover target sites for genome editing by NmCas9, the R838H mutation in the GUCY2D gene is scanned for NmCas9 PAMs. The area is scanned for PAMs having the sequence NNNNGHTT. gRNA spacer sequences (17-24 bps) located immediately upstream of the NNNNGHTT PAM are then identified. These sequences are candidates for use in editing the gene.

Example 6—CRISPR/Cpf1 PAM Sites for the R838H Mutation in the GUCY2D Gene

To discover target sites for genome editing by Cpf1, the R838H mutation in the GUCY2D gene is scanned for Cpf1 PAMs. The area is scanned for PAMs having the sequence YTN. gRNA spacer sequences (17-24 bps) located immediately upstream of the YTN PAM are then identified. These sequences are candidates for use in editing the gene.

Example 7—CRISPR/S. Pyogenes(Sp) Cas9 PAM Sites for the R838C Mutation in the GUCY2D Gene To discover target sites for genome editing by SpCas9, the R838C mutation in the GUCY2D gene was scanned for SpCas9 PAMs. The area was scanned for PAMs having the sequence NRG. gRNA spacer sequences (17-24 bps) located immediately upstream of the NRG PAM were then identified. These sequences are candidates for use in editing the gene.

Example 8—CRISPR/S. aureus(Sa) Cas9 PAM Sites for the R838C Mutation in the GUCY2D Gene To discover target sites for genome editing by SaCas9, the R838C mutation in the GUCY2D gene was scanned for SaCas9 PAMs. The area was scanned for PAMs having the sequence NNGRRT. gRNA spacer sequences (17-24 bps) located immediately upstream of the NNGRRT PAM were then identified. These sequences are candidates for use in editing the gene.

Example 9—CRISPR/S. thermophilus(St) Cas9 PAM Sites for the R838C Mutation in the GUCY2D Gene To discover target sites for genome editing by StCas9, the R838C mutation in the GUCY2D gene is scanned for StCas9 PAMs. The area is scanned for PAMs having the sequence NNAGAAW. gRNA spacer sequences (17-24 bps) located immediately upstream of the NNAGAAW PAM are then identified. These sequences are candidates for use in editing the gene.

Example 10—CRISPR/T. denticola(Td) Cas9 PAM Sites for the R838C Mutation in the GUCY2D Gene To discover target sites for genome editing by StCas9, the R838C mutation in the GUCY2D gene is scanned for TdCas9 PAMs. The area is scanned for PAMs having the sequence NAAAAC. gRNA spacer sequences (17-24 bps) located immediately upstream of the NAAAAC PAM are then identified. These sequences are candidates for use in editing the gene.

Example 11—CRISPR/N. meningitides(Nm) Cas9 PAM Sites for the R838C Mutation in the GUCY2D Gene To discover target sites for genome editing by NmCas9, the R838C mutation in the GUCY2D gene is scanned for NmCas9 PAMs. The area is scanned for PAMs having the sequence NNNNGHTT. gRNA spacer sequences (17-24 bps) located immediately upstream of the NNNNGHTT PAM are then identified. These sequences are candidates for use in editing the gene.

Example 12—CRISPR/Cpf1 PAM Sites for the R838C Mutation in the GUCY2D Gene

To discover target sites for genome editing by Cpf1, the R838C mutation in the GUCY2D gene is scanned for Cpf1 PAMs. The area is scanned for PAMs having the sequence YTN. gRNA spacer sequences (17-24 bps) located immediately upstream of the YTN PAM are then identified. These sequences are candidates for use in editing the gene.

Example 13—CRISPR/S. Pyogenes(Sp) Cas9 PAM Sites for the R838S Mutation in the GUCY2D Gene To discover target sites for genome editing by SpCas9, the R838S mutation in the GUCY2D gene was scanned for SpCas9 PAMs. The area was scanned for PAMs having the sequence NRG. gRNA spacer sequences (17-24 bps) located immediately upstream of the NRG PAM were then identified. These sequences are candidates for use in editing the gene.

Example 14—CRISPR/S. aureus(Sa) Cas9 PAM Sites for the R838S Mutation in the GUCY2D Gene To discover target sites for genome editing by SaCas9, the R838S mutation in the GUCY2D gene was scanned for SaCas9 PAMs. The area was scanned for PAMs having the sequence NNGRRT. gRNA spacer sequences (17-24 bps) located immediately upstream of the NNGRRT PAM were then identified. These sequences are candidates for use in editing the gene.

Example 15—CRISPR/S. thermophilus(St) Cas9 PAM Sites for the R838S Mutation in the GUCY2D Gene To discover target sites for genome editing by StCas9, the R838S mutation in the GUCY2D gene is scanned for StCas9 PAMs. The area is scanned for PAMs having the sequence NNAGAAW. gRNA spacer sequences (17-24 bps) located immediately upstream of the NNAGAAW PAM are then identified. These sequences are candidates for use in editing the gene.

Example 16—CRISPR/T. denticola(Td) Cas9 PAM Sites for the R838S Mutation in the GUCY2D Gene To discover target sites for genome editing by TdCas9, the R838S mutation in the GUCY2D gene is scanned for TdCas9 PAMs. The area is scanned for PAMs having the sequence NAAAAC. gRNA spacer sequences (17-24 bps) located immediately upstream of the NAAAAC PAM are then identified. These sequences are candidates for use in editing the gene.

Example 17—CRISPR/N. meningitides(Nm) Cas9 PAM Sites for the R838S Mutation in the GUCY2D Gene To discover target sites for genome editing by NmCas9, the R838S mutation in the GUCY2D gene is scanned for NmCas9 PAMs. The area is scanned for PAMs having the sequence NNNNGHTT. gRNA spacer sequences (17-24 bps) located immediately upstream of the NNNNGHTT PAM are then identified. These sequences are candidates for use in editing the gene.

Example 18—CRISPR/Cpf1 PAM Sites for the R838S Mutation in the GUCY2D Gene

To discover target sites for genome editing by Cpf1, the R838S mutation in the GUCY2D gene is scanned for Cpf1 PAMs. The area is scanned for PAMs having the sequence YTN. gRNA spacer sequences (17-24 bps) located immediately upstream of the YTN PAM are then identified. These sequences are candidates for use in editing the gene.

Example 19—Design of R838CH Double Mutation sgRNAs

One problem that can arise with gene editing is specificity. A particular challenge addressed by some examples provided herein is to induce effective levels of editing in a targeted mutant allele while maintaining the integrity of wild type alleles. Furthermore, applicants were able to design gRNAs that can be used to target multiple specific mutations.

To assess alternative gRNAs and decrease targeting of the wild-type GUCY2D allele by gRNAs of the present disclosure, gRNAs that can direct editing of either the R838C allele or the R838H allele were designed. As described in previous examples, PAMs and corresponding sgRNA spacer sequences were identified for the R838C and R838H GUCY2D mutations. These two mutations occur in sequential base pairs in the GUCY2D gene, but typically do not both occur in a single patient. Applicants designed gRNAs or sgRNAs that can hybridize to (e.g., bind to) and target either mutation with a single mismatch. For example, these "R838CH double mutation" sgRNAs can hybridize with an R838C GUCY2D allele in a cell of a first patient, or, separately, with an R838H GUCY2D allele in a cell of a second patient. In each case, there is a single mismatch between the sgRNA and the mutant allele, but editing at the target locus still occurs.

An additional advantageous feature of such double mutation gRNAs or sgRNAs is that when hybridizing with a wild-type GUCY2D sequence, the double mutation gRNA or sgRNA, for example, an R838CH double mutation sgRNA, has two consecutive mismatches. The presence of two consecutive mismatches causes reduced off-target editing at the wild-type locus, compared to wild-type off-target editing caused by a single mutation sequence such as either R838C or R838H sgRNAs that bind to a wild-type GUCY2D allele with only one mismatch.

Table 7 below shows various groupings of sgRNA spacer sequences that are 19 or 20 nucleotides in length and that result in zero, one, or two mismatches when binding to the wild-type GUCY2D gene and zero or one mismatches when binding to a mutant GUCY2D allele. Bolded bases within the sgRNA sequence show the potential mismatch locations (which are also the individual bases altered by the various R838 mutations). The sgRNA spacer sequences in Table 7 are named for the allele to which they bind with zero mismatches, except for the R838CH double mutation sgRNA spacer sequences, which are named to show that they can bind either the R838C or the R838H mutant allele with one mismatch.

TABLE 7

| GUCY2D Allele(s) | Single Guide RNA (sgRNA) Sequence (5'→3') | SEQ ID NOs |
|---|---|---|
| WT GUCY2D 20 mer | UCUGAUCCGGGAGCGCACGG | 5274 |
| WT GUCY2D 19 mer | CUGAUCCGGGAGCGCACGG | 5278 |
| R838H GUCY2D 20 mer | UCUGAUCCGGGAGCACACGG | 5284 |
| R838H GUCY2D 19 mer | CUGAUCCGGGAGCACACGG | 5289 |
| R838C GUCY2D 20 mer | UCUGAUCCGGGAGUGCACGG | 5296 |
| R838C GUCY2D 19 mer | CUGAUCCGGGAGUGCACGG | 5301 |
| R838CH GUCY2D 20 mer | UCUGAUCCGGGAGUACACGG | 5398 |
| R838CH GUCY2D 19 mer | CUGAUCCGGGAGUACACGG | 5403 |
| WT GUCY2D 20 mer | GGAUCUGAUCCGGGAGCGCA | 5275 |
| WT GUCY2D 19 mer | GAUCUGAUCCGGGAGCGCA | 5279 |
| R838H GUCY2D 20 mer | GGAUCUGAUCCGGGAGCACA | 5285 |
| R838H GUCY2D 19 mer | GAUCUGAUCCGGGAGCACA | 5290 |
| R838C GUCY2D 20 mer | GGAUCUGAUCCGGGAGUGCA | 5297 |
| R838C GUCY2D 19 mer | GAUCUGAUCCGGGAGUGCA | 5300 |
| R838CH GUCY2D 20 mer | GGAUCUGAUCCGGGAGUACA | 5399 |
| R838CH GUCY2D 19 mer | GAUCUGAUCCGGGAGUACA | 5404 |
| WT GUCY2D 20 mer | CCAGCUCCUCCGUGCGCUCC | 5276 |
| WT GUCY2D 19 mer | CAGCUCCUCCGUGCGCUCC | 5280 |
| R838H GUCY2D 20 mer | CCAGCUCCUCCGUGUGCUCC | 5286 |
| R838H GUCY2D 19 mer | CAGCUCCUCCGUGUGCUCC | 5291 |
| R838C GUCY2D 20 mer | CCAGCUCCUCCGUGCACUCC | 5298 |
| R838C GUCY2D 19 mer | CAGCUCCUCCGUGCACUCC | 5302 |
| R838CH GUCY2D 20 mer | CCAGCUCCUCCGUGUACUCC | 5400 |
| R838CH GUCY2D 19 mer | CAGCUCCUCCGUGUACUCC | 5405 |
| R838H GUCY2D 20 mer | GCACACGGAGGAGCUGGAGC | 5288 |
| R838H GUCY2D 19 mer | CACACGGAGGAGCUGGAGC | 5293 |
| R838CH GUCY2D 20 mer | GUACACGGAGGAGCUGGAGC | 5401 |
| R838CH GUCY2D 19 mer | UACACGGAGGAGCUGGAGC | 5406 |
| WT GUCY2D 20 mer | CCGGGAGCGCACGGAGGAGC | 5277 |
| WT GUCY2D 19 mer | CGGGAGCGCACGGAGGAGC | 5281 |
| R838H GUCY2D 20 mer | CCGGGAGCACACGGAGGAGC | 5287 |
| R838H GUCY2D 19 mer | CGGGAGCACACGGAGGAGC | 5292 |
| R838C GUCY2D 20 mer | CCGGGAGUGCACGGAGGAGC | 5299 |
| R838C GUCY2D 19 mer | CGGGAGUGCACGGAGGAGC | 5303 |
| R838CH GUCY2D 20 mer | CCGGGAGUACACGGAGGAGC | 5402 |
| R838CH GUCY2D 19 mer | CGGGAGUACACGGAGGAGC | 5407 |
| WT GUCY2D 20 mer | UCCAGCUCCUCCGUGCGCUC | 5272 |
| WT GUCY2D 19 mer | CCAGCUCCUCCGUGCGCUC | 5273 |
| R838H GUCY2D 20 mer | UCCAGCUCCUCCGUGUGCUC | 5282 |
| R838H GUCY2D 19 mer | CCAGCUCCUCCGUGUGCUC | 5283 |
| R838C GUCY2D 20 mer | UCCAGCUCCUCCGUGCACUC | 5294 |
| R838C GUCY2D 19 mer | CCAGCUCCUCCGUGCACUC | 5295 |
| R838CH GUCY2D 20 mer | UCCAGCUCCUCCGUGUACUC | 5408 |
| R838CH GUCY2D 19 mer | CCAGCUCCUCCGUGUACUC | 5409 |

These R838CH double mutation sgRNAs were designed starting from spacer sequences designed to target the R838H mutation (see Examples 1-2) and separate spacer sequences designed to target the R838C mutation (see Examples 7-8). For example, in the first grouping of Table 7, SEQ ID NOs: 5284 and 5296 are shown. SEQ ID NO: 5284 targets the R838H mutation and SEQ ID NO: 5296 targets the R838C mutation. A R838CH double mutation spacer sequence, such as SEQ ID NO: 5398, can be designed by manipulating the bases shown in bold typeface in SEQ ID NOs: 5284 and 5296. For example, SEQ ID NO: 5398 was designed by replacing the bolded C residue in SEQ ID NO: 5284 with the bolded U residue in SEQ ID NO: 5296 to yield the bolded UA sequence in SEQ ID NO: 5398. SEQ ID NO: 5398 could also be designed by starting with SEQ ID NO: 5296 and replacing the bolded G residue with an A residue of SEQ ID NO: 5284 to yield the bolded UA sequence in SEQ ID NO: 5398. SEQ ID NOs: 5284, 5296, and 5398 are all 20 mer spacer sequences.

A similar process was used to generate the 19 mer R838CH double mutation spacer sequence identified as SEQ ID NO: 5403, starting from SEQ ID NOs: 5289 and 5301.

A similar process was used to generate the sgRNAs in the remaining groupings in Table 7.

SEQ ID NOs: 5274 and 5278 (which bind to the wild-type GUCY2D allele with zero mismatches) are also shown in the first grouping of Table 7 as a reference to the wild-type GUCY2D sequence.

SEQ ID NOs: 5398-5407 refer to sgRNA spacer sequences of R838CH double mutation sgRNAs that associate with SpCas9. SEQ ID NOs: 5408-5409 refer to sgRNA spacer sequences of R838CH double mutation sgRNAs that associate with SaCas9.

The R838CH double mutation gRNAs of the present disclosure can allow for more specific editing of the R838C and/or R838H mutant alleles while reducing off-target editing of a wild type allele.

Example 20—Design of R838SH Double Mutation sgRNAs

To assess gRNAs and decrease targeting of the wild-type GUCY2D allele by gRNAs of the present disclosure, gRNAs that can direct editing of either the R838S allele or the R838H allele were designed. As described in previous examples, PAMs and corresponding sgRNA spacer sequences were identified for the R838S and R838H GUCY2D mutations. These two mutations occur in sequential base pairs in the GUCY2D gene, but typically do not both occur in a single patient. Applicants designed gRNAs or sgRNAs that can hybridize to (e.g., bind to) and target either mutation with a single mismatch. For example, these "R838SH" double mutation sgRNAs can hybridize with an R838S GUCY2D allele in a cell of a first patient, or, separately, with an R838H GUCY2D allele in a cell of a second patient. In each case, there is a single mismatch between the sgRNA and the mutant allele, but editing at the target locus still occurs.

An additional advantageous feature of such double mutation gRNAs or sgRNAs is that when hybridizing with a wild-type GUCY2D sequence, the double mutation gRNA or sgRNA, for example, a R838SH double mutation sgRNA, has two consecutive mismatches. The presence of two consecutive mismatches causes reduced off-target editing at the wild-type locus, compared to wild-type off-target editing caused by a single mutation sequence such as either R838S or R838H sgRNAs that bind to a wild-type GUCY2D allele with only one mismatch.

Table 8 below shows various groupings of sgRNA spacer sequences that are 19 or 20 nucleotides in length and that result in zero, one, or two mismatches when binding to the wild-type GUCY2D gene and zero or one mismatches when binding to a mutant GUCY2D allele. Bolded bases within the sgRNA sequence show the potential mismatch locations (which are also the individual bases altered by the various R838 mutations). The sgRNA spacer sequences in Table 8 are named for the allele to which they bind with zero mismatches, except for the R838SH double mutation sgRNA spacer sequences, which are named to show that they can bind either the R838S or the R838H mutant allele with one mismatch.

TABLE 8

| GUCY2D Allele(s) | Single Guide RNA (sgRNA) Sequence (5'→3') | SEQ ID NOs |
| --- | --- | --- |
| WT GUCY2D 20 mer | UCUGAUCCGGGAGCGCACGG | 5274 |
| WT GUCY2D 19 mer | CUGAUCCGGGAGCGCACGG | 5278 |
| R838H GUCY2D 20 mer | UCUGAUCCGGGAGCACACGG | 5284 |
| R838H GUCY2D 19 mer | CUGAUCCGGGAGCACACGG | 5289 |
| R838S GUCY2D 20 mer | UCUGAUCCGGGAGAGCACGG | 5304 |
| R838S GUCY2D 19 mer | CUGAUCCGGGAGAGCACGG | 5309 |
| R838SH GUCY2D 20 mer | UCUGAUCCGGGAGAACACGG | 5437 |
| R838SH GUCY2D 19 mer | CUGAUCCGGGAGAACACGG | 5440 |
| WT GUCY2D 20 mer | GGAUCUGAUCCGGGAGCGCA | 5275 |
| WT GUCY2D 19 mer | GAUCUGAUCCGGGAGCGCA | 5279 |
| R838H GUCY2D 20 mer | GGAUCUGAUCCGGGAGCACA | 5285 |
| R838H GUCY2D 19 mer | GAUCUGAUCCGGGAGCACA | 5290 |
| R838S GUCY2D 20 mer | GGAUCUGAUCCGGGAGAGCA | 5305 |
| R838S GUCY2D 19 mer | GAUCUGAUCCGGGAGAGCA | 5308 |
| R838SH GUCY2D 20 mer | GGAUCUGAUCCGGGAGAACA | 5436 |
| R838SH GUCY2D 19 mer | GAUCUGAUCCGGGAGAACA | 5441 |
| WT GUCY2D 20 mer | CCAGCUCCUCCGUGCGCUCC | 5276 |
| WT GUCY2D 19 mer | CAGCUCCUCCGUGCGCUCC | 5280 |
| R838H GUCY2D 20 mer | CCAGCUCCUCCGUGUGCUCC | 5286 |
| R838H GUCY2D 19 mer | CAGCUCCUCCGUGUGCUCC | 5291 |
| R838S GUCY2D 20 mer | CCAGCUCCUCCGUGCUCUCC | 5306 |
| R838S GUCY2D 19 mer | CAGCUCCUCCGUGCUCUCC | 5310 |
| R838SH GUCY2D 20 mer | CCAGCUCCUCCGUGUUCUCC | 5438 |
| R838SH GUCY2D 19 mer | CAGCUCCUCCGUGUUCUCC | 5442 |
| WT GUCY2D 20 mer | CCGGGAGCGCACGGAGGAGC | 5277 |
| WT GUCY2D 19 mer | CGGGAGCGCACGGAGGAGC | 5281 |
| R838H GUCY2D 20 mer | CCGGGAGCACACGGAGGAGC | 5287 |
| R838H GUCY2D 19 mer | CGGGAGCACACGGAGGAGC | 5292 |
| R838S GUCY2D 20 mer | CCGGGAGAGCACGGAGGAGC | 5307 |
| R838S GUCY2D 19 mer | CGGGAGAGCACGGAGGAGC | 5311 |
| R838SH GUCY2D 20 mer | CCGGGAGAACACGGAGGAGC | 5439 |
| R838SH GUCY2D 19 mer | CGGGAGAACACGGAGGAGC | 5443 |
| WT GUCY2D 20 mer | UCCAGCUCCUCCGUGCGCUC | 5272 |
| WT GUCY2D 19 mer | CCAGCUCCUCCGUGCGCUC | 5273 |
| R838H GUCY2D 20 mer | UCCAGCUCCUCCGUGUGCUC | 5282 |
| R838H GUCY2D 19 mer | CCAGCUCCUCCGUGUGCUC | 5283 |
| R838S GUCY2D 20 mer | UCCAGCUCCUCCGUGCUCUC | 5312 |
| R838S GUCY2D 19 mer | CCAGCUCCUCCGUGCUCUC | 5313 |
| R838SH GUCY2D 20 mer | UCCAGCUCCUCCGUGUUCUC | 5434 |
| R838SH GUCY2D 19 mer | CCAGCUCCUCCGUGUUCUC | 5435 |

These R838SH double mutation sgRNAs were designed starting from spacer sequences designed to target the R838H mutation (see Examples 1-2) and separate spacer sequences designed to target the R838S mutation (see Examples 13-14). For example, in the first grouping of Table 8, SEQ ID NOs: 5284 and 5304 are shown. SEQ ID NO: 5284 targets the R838H mutation and SEQ ID NO: 5304 targets the R838S mutation. An R838SH double mutation spacer sequence can be designed by manipulating the bases shown in bold typeface. For example, a R838SH double mutation sgRNA, such as SEQ ID NO: 5437, was designed by replacing the bolded C residue in SEQ ID NO: 5284 with the bolded A residue in SEQ ID NO: 5304 to yield the bolded AA sequence. This same R838SH double mutation sgRNA could also be designed by starting with SEQ ID NO: 5304 and replacing the bolded G residue with an A residue of SEQ ID NO: 5284 to yield the bolded AA sequence. SEQ ID NOs: 5284, 5304, and 5437 are all 20 mer spacer sequences.

A similar process was used to generate the 19 mer R838SH double mutation spacer sequence identified as SEQ ID NO: 5440, starting from SEQ ID NOs: 5289 and 5309.

A similar process was used to generate the sgRNAs in the remaining groupings in Table 8.

SEQ ID NOs: 5274 and 5278 (which bind to the wild-type GUCY2D allele with zero mismatches) are also shown in the first grouping of Table 8 as a reference to the wild-type GUCY2D sequence.

SEQ ID NOs: 5436-5443 refer to sgRNA spacer sequences of R838SH double mutation sgRNAs that associate with SpCas9. SEQ ID NOs: 5434-5435 refer to sgRNA spacer sequences of R838SH double mutation sgRNAs that associate with SaCas9.

The R838SH double mutation gRNAs of the present disclosure can allow for more specific editing of the R838S and/or R838H mutant alleles, while reducing off-target editing of a wild-type allele.

Example 21—Bioinformatics Analysis of the Guide RNAs

A gRNA or sgRNA can direct an RNP complex to an on-target site such as a genomic sequence for which editing is desired but may also have the potential to interact with an off-target site for which editing is not desired. To identify candidate gRNAs or sgRNAs that were likely to have on-target and/or off-target activity, candidate gRNAs were screened and selected in a single process or multi-step process that used both in silico analysis of binding and experimentally assessed activity at both on-target and off-target sites.

By way of illustration, candidate gRNAs having sequences that match a particular on-target site, such as a site within or near the R838H, R838C, or R838S mutation in the GUCY2D gene, with an adjacent PAM were assessed for their potential to cleave at off-target sites having similar sequences, using one or more of a variety of bioinformatics tools. Such tools for assessing off-target binding are known in the art, examples of which are described and illustrated in more detail below.

Candidates predicted to have relatively lower potential for off-target activity were then assessed in in vitro experiments to measure their on-target activity and off-target activities at various sites. Guide RNAs having sufficiently high on-target activity to achieve desired levels of gene editing at the selected locus, and relatively lower off-target activity to reduce the likelihood of alterations at other chromosomal loci are useful for modifying mutant GUCY2D. The ratio of on-target to off-target activity is often referred to as the "specificity" of a guide.

For initial screening of predicted off-target activities, bioinformatics tools known and publicly available were used to predict the most likely off-target sites. Because binding to target sites in the CRISPR/Cas9/Cpf1 nuclease system is driven by Watson-Crick base pairing between complementary sequences, the degree of dissimilarity (and therefore reduced potential for off-target binding) was related to primary sequence differences: mismatches and bulges, i.e. bases that were changed to a non-complementary base, and insertions or deletions of bases in the potential off-target site relative to the target site. An exemplary bioinformatics tool called COSMID (CRISPR Off-target Sites with Mismatches, Insertions and Deletions) (available at crispr.bme.gatech.edu) compiles such similarities. Other bioinformatics tools include, but are not limited to autoCOSMID and CCTop.

Bioinformatics tools were used to minimize off-target cleavage in order to reduce the detrimental effects of mutations and chromosomal rearrangements. Studies on CRISPR/Cas9 systems suggested the possibility of off-target activity due to non-specific hybridization of the guide strand to DNA sequences with base pair mismatches and/or bulges, particularly at positions distal from the PAM region. Therefore, it was important to have a bioinformatics tool that identified potential off-target sites that have insertions and/or deletions between the RNA guide strand and genomic sequences, in addition to base-pair mismatches. Bioinformatics tools based upon the off-target prediction algorithm CCTop were used to search genomes for potential CRISPR off-target sites (CCTop is available on the web at crispr.cos.uni-heidelberg.de/). The output ranked lists of the potential off-target sites based on the number and location of mismatches, allowing more informed choice of target sites, and avoiding the use of sites with more likely off-target cleavage.

Additional bioinformatics pipelines were employed that weigh the estimated on- and/or off-target activity of gRNA targeting sites in a region. Other features that were used to predict activity include information about the cell type in question, DNA accessibility, chromatin state, transcription factor binding sites, transcription factor binding data, and other CHIP-seq data. Additional factors were weighed that predict editing efficiency, such as relative positions and directions of pairs of gRNAs, local sequence features and micro-homologies.

These processes allow for selection of high specificity gRNAs or sgRNAs for further development.

Example 22—Testing of Guide RNAs in Cells for Off-Target Activity

To further evaluate the specificity of gRNAs provided herein, selected gRNAs predicted to have the lowest off-target activity were tested for off-target editing efficiency.

HEK 293FT cells with SpCas9 open reading frame (ORF) regulated by a constitutive promoter integrated into the AAVS1 locus were cultured in 10% heat inactivated (HI) FBS/DMEM supplemented with 1 µg/ml puromycin, and passaged every 3-4 days.

The HEK 293FT cell line expressing SpCas9 was seeded in 100 µl of 10% HI-FBS/DMEM at 50,000 cells per well in a 96-well plate, and transfected with 1 µg of sgRNA using Lipofectamine® MessengerMax™ (available from Thermo Fisher Scientific, Massachusetts, US). sgRNAs used for this assay were synthesized by in vitro transcription (IVT). The DNA fragments containing bacteriophage T7 promoter, protospacer and sgRNA tracer sequences were generated by assembling oligonucleotides through PCR. IVT was performed using the TranscriptAid T7 High Yield Transcription Kit (available from Thermo Fisher Scientific), and the synthesized RNA strands were purified using either ZR-96 RNA Clean & Concentrator™ (available from Zymo Research, California, US) or RNAClean XP beads (available from Beckman Coulter, California, US).

At 48 hours post-transfection, medium was removed and total DNA was extracted using prepGem® Tissue Kit (available from VWR, Pennsylvania, US). The sequence surrounding the Cas9 target sites on the genome was PCR-amplified. The Cas9 target sites on the genome were the wild-type GUCY2D locus, the R838H mutation, the R838C mutation, or the R838S mutation. The resulting products were cleaned up using AMPure XP beads (available from Beckman Coulter), and sequenced to assess Cas9-mediated genetic modifications. The frequencies of small insertions and deletions (indels) were estimated using TIDE.

On-target editing efficiency was determined at the wild-type GUCY2D locus via TIDE analysis for sgRNAs that target the wild-type GUCY2D gene (FIGS. 4A-D; sgRNAs comprising SEQ ID NOs: 5274, 5278, 5275, 5279, 5276, 5280, 5277, or 5281). These sgRNAs that target the wild-type GUCY2D locus were used as positive controls to measure on-target editing at the wild-type GUCY2D locus.

Off-target editing efficiency was determined at the wild-type GUCY2D locus via TIDE analysis for sgRNAs that target the R838H mutation (FIGS. 4A-E; sgRNAs comprising SEQ ID NOs: 5284, 5289, 5285, 5290, 5286, 5291, 5287, 5292, 5288, or 5293).

Off-target editing efficiency was also determined at the wild-type GUCY2D locus via TIDE analysis for sgRNAs that target the R838C mutation (FIGS. 4A-D; sgRNAs comprising SEQ ID NOs: 5296, 5300, 5297, 5301, 5298, 5302, 5299, or 5303).

Off-target editing efficiency was also determined at the wild-type GUCY2D locus via TIDE analysis for sgRNAs that target the R838S mutation (FIGS. 4A-D; sgRNAs comprising SEQ ID NOs: 5304, 5308, 5305, 5309, 5306, 5310, 5307, or 5311).

Off-target editing efficiency was also determined at the wild-type GUCY2D locus via TIDE analysis for sgRNAs that are able to target both the R838H mutation and R838C mutation (FIGS. 4A-E; sgRNAs comprising SEQ ID NOs: 5398, 5403, 5399, 5404, 5400, 5405, 5402, 5407, 5401, or 5406).

These data provide evidence that the selected gRNAs can minimize off-target activity (FIGS. 4A-E).

Example 23—Testing of Guide RNAs in Cells for On-Target Activity

To further evaluate the specificity of gRNAs provided herein, selected gRNAs predicted to have the lowest off-target activity were also tested for on-target editing efficiency.

HEK 293FT cells expressing SpCas9 were collected and resuspended in SF solution at 10,000,000 cells per ml. 20 µl of the cell suspension was transfected with 2 µg of sgRNA and 200, 400 or 800 ng of either a plasmid encoding the wild-type GUCY2D gene or a plasmid encoding the R838H mutation. The transfection of the HEK 293 FT cells was performed by nucleofection under the program CM-130 using Lonza 4D nucleofector system.

sgRNAs used for this assay were synthesized by IVT. The DNA fragments containing bacteriophage T7 promoter, protospacer and sgRNA tracer sequences were generated by assembling oligonucleotides through PCR. IVT was performed using TranscriptAid T7 High Yield Transcription Kit, and the synthesized RNA strands were purified using either ZR-96 RNA Clean & Concentrator™ or RNA clean XP beads (Beckman Coulter).

A plasmid encoding the wild-type GUCY2D gene or a plasmid encoding GUCY2D comprising the R838H mutation was built by two rounds of molecular cloning. First, pSpCas9 (purchased from Genscript, New Jersey, US) was digested with KpnI-HF and EcoRI-HF, and a PCR fragment containing human rhodopsin kinase promoter (GRK1) and the sequence encoding the amino-acid residue 962 through the C-terminus of human GUCY2D was inserted between the two digestion sites.

The resulting plasmid and ORF cDNA clones encoding the wild type GUCY2D (purchased from Genecopoeia) were digested with BstBI and NdeI, and the linearized fragments were ligated with T4 DNA ligase to insert the full-length wild-type GUCY2D gene downstream of the GRK1 promoter.

In addition, the resulting plasmid and ORF cDNA clones encoding the R838H mutation (purchased from Genecopoeia) were digested with BstBI and NdeI, and the linearized fragments were ligated with T4 DNA ligase to insert the full-length R838H containing GUCY2D gene downstream of the GRK1 promoter.

Each 25 µl of the nucleofection samples was transferred into 1-well containing 175 µl of 10% HI-FBS/DMEM in 96-well plates. At 48-hours post-transfection, each well was washed with PBS twice, and total DNA was extracted using prepGem® Tissue Kit. The sequence surrounding Cas9 target sites on the plasmid DNA was PCR-amplified. The resulting products were cleaned up using AMPure XP beads, and sequenced to assess Cas9-mediated genetic modifications. The frequencies of small insertions and deletions (indels) were estimated using TIDE.

On-target editing efficiency was determined at the wild-type GUCY2D locus via TIDE analysis for sgRNAs that target the wild-type GUCY2D gene (FIG. 5; sgRNAs comprising SEQ ID NO: 5274).

On-target editing efficiency was also determined at the R838H mutation of the GUCY2D gene via TIDE analysis for sgRNAs that target the R838H mutation (FIG. 5; sgRNAs comprising SEQ ID NO: 5284, 5285, 5286, 5287, or 5288).

On-target editing efficiency was also determined at the R838H mutation of the GUCY2D gene via TIDE analysis for sgRNAs that are able to target both the R838H mutation and R838C mutation (FIG. 5; sgRNAs comprising SEQ ID NO: 5398, 5399, 5400, 5401, or 5402).

These data provide evidence that selected gRNAs designed by Applicants can effectively edit a GUCY2D gene harboring a R838H mutation (FIG. 5).

Example 24—Testing of Guide RNAs in Cells for On-Target and Off-Target Activity

To further evaluate the specificity of gRNAs provided herein, selected gRNAs were further tested for on-target and off-target activity.

A sequence containing human U6 promoter, seamless protospacer cloning site, sgRNA tracer, CMV promoter, chimeric intron, EGFP ORF, WPRE and SV40 polyadenylation signal was synthesized using GeneArt service (ThermoFisher Scientific). This sequence was separated from the vector backbone by digestion with MluI-HF and RsrII, and cloned between the same sites on the AAV vector. The resulting plasmid (pSIA003) was digested with SapI, and synthesized oligonucleotides were annealed to generate protospacers with 3-nt overhangs compatible with those of the linearized pSIA003. The double-stranded protospacers were inserted into pSIA003 by DNA ligation.

HEK 293FT SpCas9-expressing cells were transfected with 200, 400 or 800 ng of pSIA003, which contains a U6-driven sgRNA. HEK 293FT SpCas9 expressing cell samples were referenced in FIGS. 6A-B as 2, 4, and 8 in their sample names depending on the concentration of pSIA003 that was used (200, 400, or 800 ng). At the same time that HEK 293FT SpCas9-expressing cells were transfected with pSIA003, they were also transfected with 200 ng of a plasmid encoding the wild-type GUCY2D gene, a plasmid encoding GUCY2D comprising the R838H mutation, or a plasmid encoding GUCY2D comprising the R838C mutation. The transfection of the HEK 293FT cells was performed by nucleofection under the program CM-130 using a Lonza 4D-Nucleofector™ system (available from Lonza, Switzerland).

Each 25 µl of the nucleofection samples was transferred into 1-well containing 175 µl of 10% HI-FBS/DMEM in 96-well plates. At 48 and 72 hours post-transfection, each well was washed with PBS twice, then total DNA was extracted using prepGem Tissue Kit. The sequence surrounding Cas9 target sites on the plasmid DNA was PCR-amplified. The resulting products were cleaned up using AMPure XP beads, and sequenced to assess Cas9-mediated genetic modifications. The frequencies of small insertions and deletions (indels) were estimated using TIDE.

On-target editing efficiency was determined at the wild-type GUCY2D locus via TIDE analysis for a sgRNA that targets the wild-type GUCY2D gene (sgRNA comprising SEQ ID NO: 5274) at 48 hours (FIG. 6A) and 72 hours (FIG. 6B) post-transfection.

On-target and off-target editing efficiency was also determined at the wild-type GUCY2D locus, the R838H mutation of the GUCY2D gene, and the R838C mutation of the GUCY2D gene via TIDE analysis for sgRNAs that target the R838H mutation (sgRNAs comprising SEQ ID NOs: 5285 or 5286) at 48 hours (FIG. 6A) and 72 hours (FIG. 6B) post-transfection.

On-target and off-target editing efficiency was also determined at the wild-type GUCY2D locus, the R838H mutation of the GUCY2D gene, and the R838C mutation of the GUCY2D gene via TIDE analysis for sgRNAs that are able to target both the R838H mutation and R838C mutation (sgRNAs comprising SEQ ID NOs: 5398, 5399, or 5402) at 48 hours (FIG. 6A) and 72 hours (FIG. 6B) post-transfection.

Figure 6A:
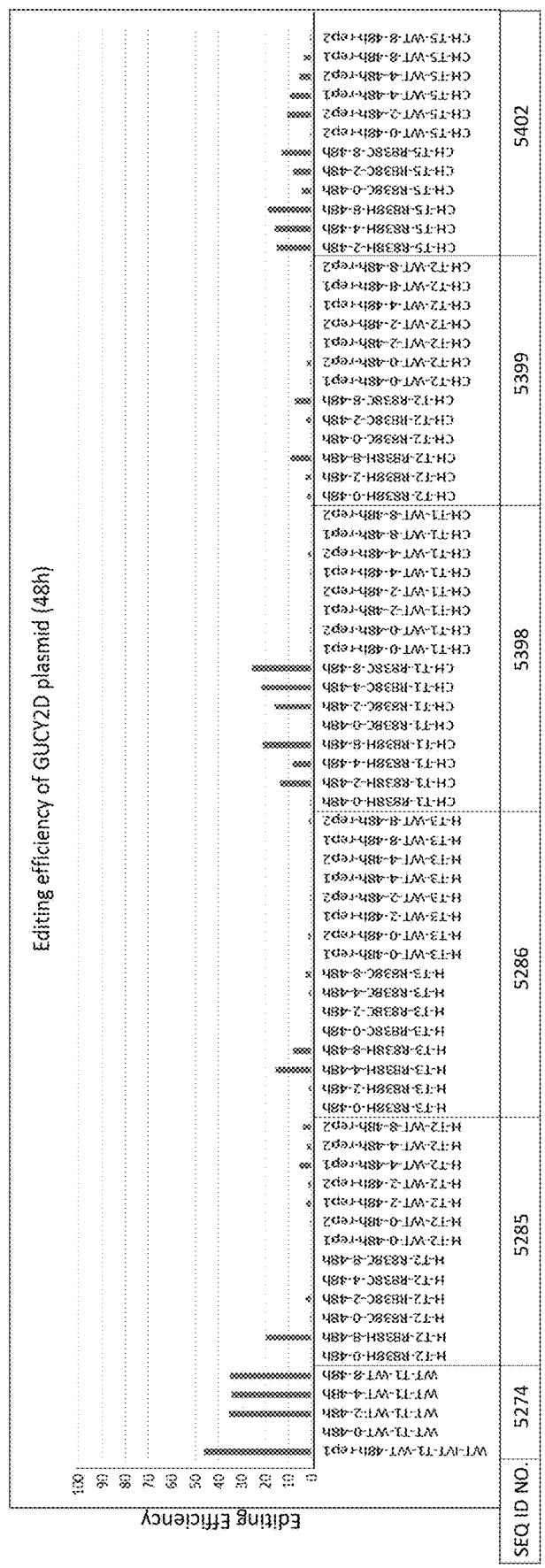
FIGS. 6A-B describe the on-target and off-target editing efficiency of a plasmid transcribed sgRNA targeting the wild-type GUCY2D gene (a sgRNA comprising SEQ ID NO: 5274) at 48 or 72 hours post transfection and the on-target and off-target editing efficiency of plasmid transcribed sgRNAs targeting the R838H or R838C mutation within the GUCY2D gene (sgRNAs comprising SEQ ID NO: 5285, 5286, 5398, 5399, or 5402) at 48 or 72 hours post transfection.
Figure 6B:
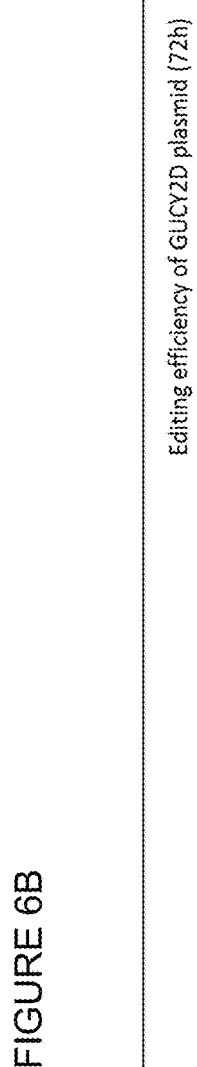

These data provide evidence that the selected gRNAs can effectively edit the GUCY2D mutations R838C and R838H while minimizing off-target activity (FIGS. 6A-B).

Example 25—Testing of Guide RNAs in Cells for On-Target and Off-Target Activity

To further evaluate the specificity of gRNAs provided herein, selected gRNAs were further tested for on-target and off-target activity when targeting a genomic GUCY2D allele for editing.

Three reporter cell lines were generated that contain a Cas9 target site fused to a blue fluorescent protein at the beta-tubulin gene locus. The first reporter cell line has a wild-type GUCY2D gene (Cas9 target site) fused to a blue fluorescent protein at the beta-tubulin gene locus. The second reporter cell line has a GUCY2D gene comprising a R838H mutation (Cas9 target site) fused to a blue fluorescent protein at the beta-tubulin gene locus. The third reporter cell line has a GUCY2D gene comprising a R838C mutation (Cas9 target site) fused to a blue fluorescent protein at the beta-tubulin gene locus.

Figure 7A:
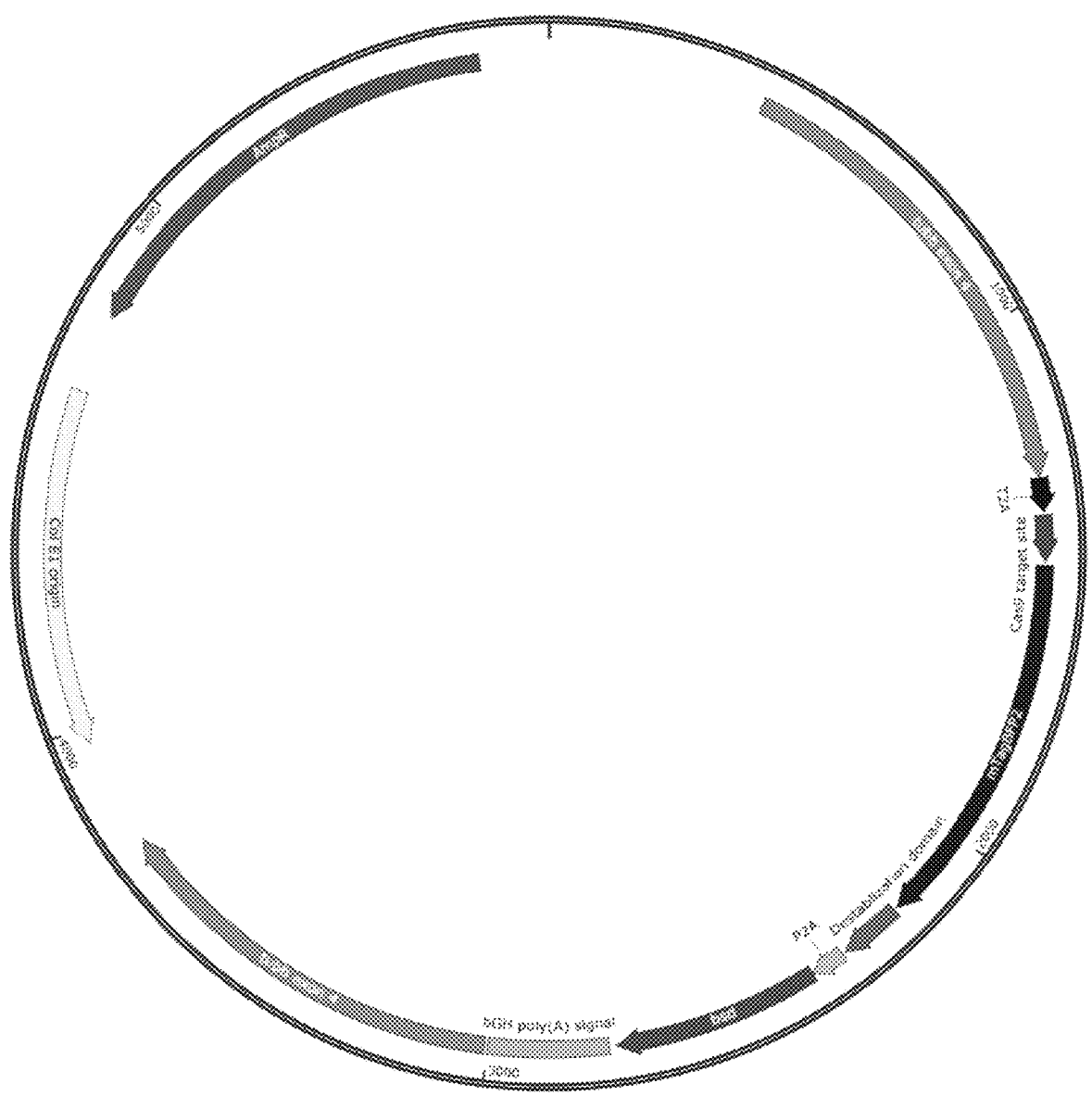

These three reporter cell lines were generated using pDL124 and a donor plasmid. pDL124 contains a SpCas9 ORF under CMV promoter and a U6 promoter-driven sgRNA and was built by Gibson assembly. The U6 promoter-driven sgRNA can cut the codon corresponding to the third residue from the C-terminus of beta-tubulin. A donor plasmid (FIG. 7A) comprises a Cas9 target site (either a wild-type GUCY2D gene, a GUCY2D gene comprising a R838H mutation, or a GUCY2D gene comprising a R838C mutation). Each of these 3 donor plasmids was synthesized using GeneArt service (ThermoFisher Scientific).

HEK 293FT cells (200,000 cells) were transfected with 0.5 μg of pDL124 and 0.5 μg of donor plasmid by nucleofection under the program DN-100. pDL124 was used to generate a double-strand break at the beta-tubulin gene locus of the HEK 293FT cells in order to integrate the Cas9 target site (i.e. the wild-type GUCY2D gene, the GUCY2D gene comprising the R838H mutation, or the GUCY2D gene comprising the R838C mutation) from the donor plasmid and into the beta-tubulin gene locus of the HEK 293FT cells between the two homologous arms (tubb exon 4). Homologous recombination leads to expression of beta-tubulin fused to T2A peptide. The Cas9 target site includes no stop codon, and blue fluorescent protein (mTagBFP2) and blasticidin selection marker (bsd) are encoded in the same reading frame as for beta-tubulin. Cells with a Cas9 target site integrated correctly were enriched in 10% FBS/DMEM supplemented with 2-5 μg/ml blasticidin, and isolated by cell sorting. Each of the reporter cell lines was seeded in 2.5 ml of 10% FBS/DMEM at 500,000 cells per well in 6-well plates 24 hours before transfection.

The reporter cell line having a wild-type GUCY2D gene (Cas9 target site) fused to a blue fluorescent protein at the beta-tubulin gene locus was transfected with 1.25 μg pSIA043 and 1.25 μg pSIA012 using Lipofectamine® 3000 (FIG. 7B). pSIA043 encodes Cas9. A nucleotide sequence containing GRK1-driven SpCas9 and SV40 polyadenylation signal was synthesized using GeneArt service (ThermoFisher Scientific), and transferred onto the AAV vector by conventional DNA cloning techniques. The human elongation factor 1 alpha promoter was PCR-amplified, and substituted for GRK1 promoter. The resulting plasmid was designated as pSIA043. pSIA012 is pAAV-5285, which comprises an AAV sequence that encodes for R838H_Sp_T2 sgRNA (a sgRNA comprising SEQ ID NO: 5285) and EGFP (SEQ ID NO: 5469).

The reporter cell line having a GUCY2D gene comprising a R838H mutation (Cas9 target site) fused to a blue fluorescent protein at the beta-tubulin gene locus was transfected with 1.25 μg pSIA043 and 1.25 μg pSIA012 using Lipofectamine® 3000 (FIG. 7E).

The reporter cell line having a GUCY2D gene comprising a R838C mutation (Cas9 target site) fused to a blue fluorescent protein at the beta-tubulin gene locus was transfected with 1.25 μg pSIA043 and 1.25 μg pSIA012 using Lipofectamine® 3000 (FIG. 7H).

The reporter cell line having a wild-type GUCY2D gene (Cas9 target site) fused to a blue fluorescent protein at the beta-tubulin gene locus was transfected with 1.25 μg pSIA043 and 1.25 μg pSIA015 using Lipofectamine® 3000 (FIG. 7C). pSIA015 is pAAV-5398, a pAAV comprising a sequence that encodes for R838CH_Sp_T1 sgRNA (a sgRNA comprising SEQ ID NO: 5398) and EGFP (SEQ ID NO: 5471).

The reporter cell line having a GUCY2D gene comprising a R838H mutation (Cas9 target site) fused to a blue fluorescent protein at the beta-tubulin gene locus was transfected with 1.25 μg pSIA043 and 1.25 μg pSIA015 using Lipofectamine® 3000 (FIG. 7F).

The reporter cell line having a GUCY2D gene comprising a R838C mutation (Cas9 target site) fused to a blue fluorescent protein at the beta-tubulin gene locus was transfected with 1.25 μg pSIA043 and 1.25 μg pSIA015 using Lipofectamine® 3000 (FIG. 7I).

The reporter cell line having a wild-type GUCY2D gene (Cas9 target site) fused to a blue fluorescent protein at the beta-tubulin gene locus was transfected with only transfection reagent (no DNA) using Lipofectamine® 3000 (FIG. 7D).

The reporter cell line having a GUCY2D gene comprising a R838H mutation (Cas9 target site) fused to a blue fluorescent protein at the beta-tubulin gene locus was transfected with only transfection reagent (no DNA) using Lipofectamine® 3000 (FIG. 7G).

The reporter cell line having a GUCY2D gene comprising a R838C mutation (Cas9 target site) fused to a blue fluorescent protein at the beta-tubulin gene locus was transfected with only transfection reagent (no DNA) using Lipofectamine® 3000 (FIG. 7J).

At 72 hours post-transfection, reporter cells were dissociated from the plates by incubation with trypsin-EDTA, and analyzed for blue fluorescence (BFP) and green fluorescence (GFP) by flow cytometry. A frame-shift induced by genome editing at a Cas9 target site (whether the Cas9 target site is the wild-type GUCY2D gene, the GUCY2D gene comprising the R838H mutation, or the GUCY2D gene comprising the R838C mutation) of the HEK 293FT cell results in loss of BFP. EGFP and sgRNA are encoded on the same vector and the EGFP serves as a transfection marker. Therefore, HEK 293FT cells transfected with pSIA012 (which comprises a sequence that encodes R838H_Sp_T2 sgRNA—a sgRNA comprising SEQ ID NO: 5285) or pSIA015 (which comprises a sequence that encodes R838CH_Sp_T1 sgRNA—a sgRNA comprising SEQ ID NO: 5398) are GFP positive.

Gene editing in the transfected cells was estimated in the cell populations plotted within gate "B" (FIGS. 7B-7J). The bolded percentages in FIGS. 7B-7J indicate BFP negative and GFP positive cells within gate "B". BFP negative means that gene editing occurred at the Cas9 target site of these transfected HEK 293FT cells. GFP positive means that these transfected HEK 293FT cells contain a plasmid that encodes EGFP and sgRNA.

FIG. 7B shows that of the transfected HEK 293FT reporter cells that have the wild-type GUCY2D gene as the Cas9 target site, 16.67% of these cells had the wild-type GUCY2D gene edited when R838H_Sp_T2 sgRNA (sgRNA comprising SEQ ID NO: 5285) was used as the sgRNA.

FIG. 7C shows that of the transfected HEK 293FT reporter cells that have the wild-type GUCY2D gene as the Cas9 target site, 3.38% of these cells had the wild-type GUCY2D gene edited when R838CH_Sp_T1 sgRNA (sgRNA comprising SEQ ID NO: 5398) was used as the sgRNA.

FIG. 7D shows that of the transfected HEK 293FT reporter cells that have the wild-type GUCY2D gene as the Cas9 target site, 0% of these cells had the wild-type GUCY2D gene edited when no sgRNA was used.

FIG. 7E shows that of the transfected HEK 293FT reporter cells that have the R838H mutation as the Cas9 target site, 52.37% of these cells had the R838H mutation edited when R838H_Sp_T2 sgRNA (sgRNA comprising SEQ ID NO: 5285) was used as the sgRNA.

FIG. 7F shows that of the transfected HEK 293FT reporter cells that have the R838H mutation as the Cas9 target site, 16.14% of these cells had the R838H mutation edited when R838CH_Sp_T1 sgRNA (sgRNA comprising SEQ ID NO: 5398) was used as the sgRNA.

FIG. 7G shows that of the transfected HEK 293FT reporter cells that have the R838H mutation as the Cas9 target site, 0% of these cells had the R838H mutation edited when no sgRNA was used.

FIG. 7H shows that of the transfected HEK 293FT reporter cells that have the R838C mutation as the Cas9 target site, 1.89% of these cells had the R838C mutation edited when R838H_Sp_T2 sgRNA (sgRNA comprising SEQ ID NO: 5285) was used as the sgRNA.

FIG. 7I shows that of the transfected HEK 293FT reporter cells that have the R838C mutation as the Cas9 target site, 24.47% of these cells had the R838C mutation edited when R838CH_Sp_T1 sgRNA (sgRNA comprising SEQ ID NO: 5398) was used as the sgRNA.

FIG. 7J shows that of the transfected HEK 293FT reporter cells that have the R838C mutation as the Cas9 target site, 0% of these cells had the R838C mutation edited when no sgRNA was used.

Because no genome editing was induced in mock transfected cells, the vast majority of mock transfected cells are BFP positive (FIGS. 7D, 7G, and 7J).

Genomic DNA was also extracted from reporter cells 72-hours post-transfection using Zymo Research Quick-DNA plus kit. The sequence spanning Cas9 target sites upstream of the fluorescent protein gene was PCR-amplified, and indels were analyzed by TIDE (data not shown). The results of those data not shown were in agreement with the results observed by flow cytometry analysis.

These data provide evidence that the tested gRNAs can effectively edit the mutant R838H GUCY2D gene and R838C GUCY2D gene while minimizing off-target activity (FIGS. 7B-J).

Example 26—cGMP Functional Assay

The GUCY2D protein is a guanylate cyclase, which synthesizes cGMP in mammalian photoreceptor cells. A cGMP functional assay was established as an on-target screening approach for R838H sgRNA screening. In the assay, in vitro-transcribed (IVT) sgRNAs and a vector containing R838H cDNA were co-transfected into HEK293T-SpCas9 cells. Editing of the R838H cDNA can result in reduction of GUCY2D protein production, and consequently decreased cGMP signal. Assays were also conducted using AAV-encoded sgRNAs. The editing efficiency of gRNAs was directly proportional to the percent reduction of cGMP in cells transfected with sgRNAs.

A total of 10 sgRNAs targeting the R838H mutation within the GUCY2D gene (sgRNAs comprising SEQ ID NOs: 5284, 5285, 5286, 5287, 5288, 5289, 5290, 5291, 5292, or 5293) were screened for on-target editing using the cGMP functional assay. To calculate percent reduction of cGMP (FIG. 8A), HEK293T-SpCas9 cells co-transfected with (1) a R838H IVT sgRNA and (2) a vector containing R838H cDNA were compared to HEK293T-SpCas9 cells that were not transfected with any sgRNA but did receive the cDNA vector. For example, HEK293T-SpCas9 cells co-transfected with a vector containing R838H cDNA and sgRNA comprising SEQ ID NO: 5284 had a 69.1% reduction of cGMP, which demonstrates that the sgRNA comprising SEQ ID NO: 5284 was able to edit the R838H mutation within the GUCY2D gene. HEK293T-SpCas9 cells co-transfected with a vector containing R838H cDNA and sgRNA comprising SEQ ID NO: 5285 had a 72.5% reduction of cGMP, which demonstrates that the sgRNA comprising SEQ ID NO: 5285 was able to edit the R838H mutation within the GUCY2D gene. HEK293T-SpCas9 cells co-transfected with a vector containing R838H cDNA and sgRNA comprising SEQ ID NO: 5286 had a 51.9% reduction of cGMP, which demonstrates that the sgRNA comprising SEQ ID NO: 5286 was able to edit the R838H mutation within the GUCY2D gene. HEK293T-SpCas9 cells co-transfected with a vector containing R838H cDNA and sgRNA comprising SEQ ID NO: 5287 had a 25.9% reduction of cGMP, which demonstrates that the sgRNA comprising SEQ ID NO: 5287 was able to edit the R838H mutation within the GUCY2D gene. HEK293T-SpCas9 cells co-transfected with a vector containing R838H cDNA and sgRNA comprising SEQ ID NO: 5288 had a 28.1% reduction of cGMP, which demonstrates that the sgRNA comprising SEQ ID NO: 5288 was able to edit the R838H mutation within the GUCY2D gene. HEK293T-SpCas9 cells co-transfected with a vector containing R838H cDNA and sgRNA comprising SEQ ID NO: 5289 had a 73.1% reduction of cGMP, which demonstrates that the sgRNA comprising SEQ ID NO: 5289 was able to edit the R838H mutation within the GUCY2D gene. HEK293T-SpCas9 cells co-transfected with a vector containing R838H cDNA and sgRNA comprising SEQ ID NO: 5290 had a 70.3% reduction of cGMP, which demonstrates that the sgRNA comprising SEQ ID NO: 5290 was able to edit the R838H mutation within the GUCY2D gene. HEK293T-SpCas9 cells co-transfected with a vector containing R838H cDNA and sgRNA comprising SEQ ID NO: 5291 had a 60.1% reduction of cGMP, which demonstrates that the sgRNA comprising SEQ ID NO: 5291 was able to edit the R838H mutation within the GUCY2D gene. HEK293T-SpCas9 cells co-transfected with a vector containing R838H cDNA and sgRNA comprising SEQ ID NO: 5292 had a 47.8% reduction of cGMP, which demonstrates that the sgRNA comprising SEQ ID NO: 5292 was able to edit the R838H mutation within the GUCY2D gene. HEK293T-SpCas9 cells co-transfected with a vector containing R838H cDNA and sgRNA comprising SEQ ID NO: 5293 had a 20.9% reduction of cGMP, which demonstrates that the sgRNA comprising SEQ ID NO: 5293 was able to edit the R838H mutation within the GUCY2D gene. Absolute cGMP was also determined for these same samples (FIG. 8B).

A sgRNA comprising SEQ ID NO: 5277 that targets the wild-type GUCY2D gene and a vector containing wild-type GUCY2D cDNA were co-transfected into HEK293T-SpCas9 cells and used as a control. Editing of wild-type GUCY2D cDNA using the sgRNA that targets the wild-type GUCY2D gene resulted in an 80% reduction of cGMP (data not shown), which demonstrates that the sgRNA comprising SEQ ID NO: 5277 was able to edit the wild-type GUCY2D. Percent reduction of cGMP was calculated by comparing the cGMP levels of cells transfected with the sgRNA comprising SEQ ID NO: 5277 that targets the wild-type GUCY2D gene compared to cells that were not transfected with any sgR-NAs (data not shown). Editing of wild-type GUCY2D cDNA using the sgRNA that targets the wild-type GUCY2D gene resulted in ~225 nM cGMP (data not shown).

Figure 9A:
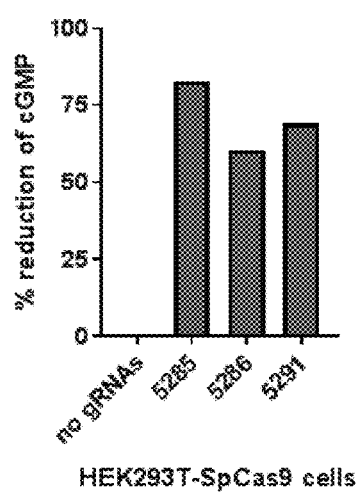
FIGS. 9A-B are graphs showing the percent reduction of cGMP and absolute cGMP for HEK293T-SpCas9 cells co-transfected with a vector containing R838H cDNA and IVT sgRNAs that target the R838H mutation within the GUCY2D gene.
Figure 9B:
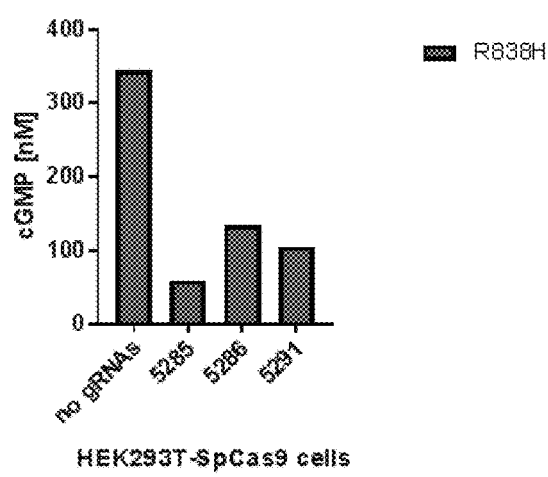

In a second cGMP functional assay, an IVT sgRNA and a vector containing R838H cDNA were co-transfected into HEK293T-SpCas9 cells. Three sgRNAs that target the R838H mutation within the GUCY2D gene (sgRNAs comprising SEQ ID NOs: 5285, 5286 or 5291) were screened for on-target editing using the cGMP functional assay. To calculate percent reduction of cGMP (FIG. 9A), HEK293T-SpCas9 cells co-transfected with (1) a R838H IVT sgRNA and (2) a vector containing R838H cDNA were compared to HEK293T-SpCas9 cells that were not transfected with any sgRNA but did receive the cDNA vector. For example, HEK293T-SpCas9 cells co-transfected with a vector containing R838H cDNA and sgRNA comprising SEQ ID NO: 5285 had an 82.7% reduction of cGMP, which demonstrates that the sgRNA comprising SEQ ID NO: 5285 was able to edit the R838H mutation within the GUCY2D gene. HEK293T-SpCas9 cells co-transfected with a vector containing R838H cDNA and sgRNA comprising SEQ ID NO: 5286 had a 60.5% reduction of cGMP, which demonstrates that the sgRNA comprising SEQ ID NO: 5286 was able to edit the R838H mutation within the GUCY2D gene. HEK293T-SpCas9 cells co-transfected with a vector containing R838H cDNA and sgRNA comprising SEQ ID NO: 5291 had a 69.1% reduction of cGMP, which demonstrates that the sgRNA comprising SEQ ID NO: 5291 was able to edit the R838H mutation within the GUCY2D gene. Absolute cGMP was also determined for these same samples (FIG. 9B)

In a third cGMP functional assay, an AAV vector encoding a sgRNA driven by a U6 promoter (pAAV-U6-sgRNA) and a vector containing R838H cDNA were co-transfected into HEK293T-SpCas9 cells. sgRNAs that target the R838H mutation within the GUCY2D gene (sgRNAs comprising SEQ ID NOs: 5285 or 5286) were screened for on-target editing using the cGMP functional assay. Percent reduction of cGMP (FIG. 10A) was calculated by comparing the cGMP level of HEK293T-SpCas9 cells co-transfected with a pAAV-U6-R838H sgRNA and a vector containing R838H cDNA with HEK293T-SpCas9 cells that were not transfected with any pAAV-U6-R838H sgRNA. For example, HEK293T-SpCas9 cells co-transfected with a vector containing R838H cDNA and pSIA012 (also called pAAV-5285), a plasmid comprising an AAV sequence that encodes for a sgRNA comprising SEQ ID NO: 5285) had a 41.3% reduction of cGMP, which demonstrates that the sgRNA comprising SEQ ID NO: 5285 was able to edit the R838H mutation within the GUCY2D gene. HEK293T-SpCas9 cells co-transfected with a vector containing R838H cDNA and pAAV-U6-R838H sgRNA (also called pAAV-5286, a plasmid comprising an AAV sequence that encodes for a sgRNA comprising SEQ ID NO: 5286) had a 16.5% reduction of cGMP, which demonstrates that the sgRNA comprising SEQ ID NO: 5286 was able to edit the R838H mutation within the GUCY2D gene. HEK293T-SpCas9 cells co-transfected with a vector containing R838H cDNA and pAAV-U6-WT sgRNA (a pAAV-5274, a plasmid comprising an AAV sequence that encodes for a sgRNA comprising SEQ ID NO: 5274) had a 0% reduction of cGMP, which demonstrates that the sgRNA comprising SEQ ID NO: 5274 was not able to edit the R838H mutation within the GUCY2D gene. Absolute cGMP was also determined for these same samples (FIG. 10B)

An AAV vector encoding a sgRNA driven by a U6 promoter that targets the wild-type GUCY2D gene (pAAV-5274, a plasmid comprising an AAV sequence that encodes for a sgRNA comprising SEQ ID NO: 5274) and a vector containing wild-type GUCY2D cDNA were co-transfected into HEK293T-SpCas9 cells and used as a control. Editing of wild-type GUCY2D cDNA using the sgRNA comprising SEQ ID NO: 5274 that targets the wild-type GUCY2D gene resulted in a 42.2% reduction of cGMP (data not shown), which demonstrates that the sgRNA comprising SEQ ID NO: 5274 was able to edit the wild-type GUCY2D. Percent reduction of cGMP was calculated by comparing the cGMP level of HEK293T-SpCas9 cells co-transfected with a sgRNA comprising SEQ ID NO: 5274 that targets the wild-type GUCY2D gene compared to cells that were not transfected with any sgRNAs (data not shown). Editing of wild-type GUCY2D cDNA using pAAV comprising SEQ ID NO: 5274 resulted in ~325 nM cGMP (data not shown).

Figure 10A:
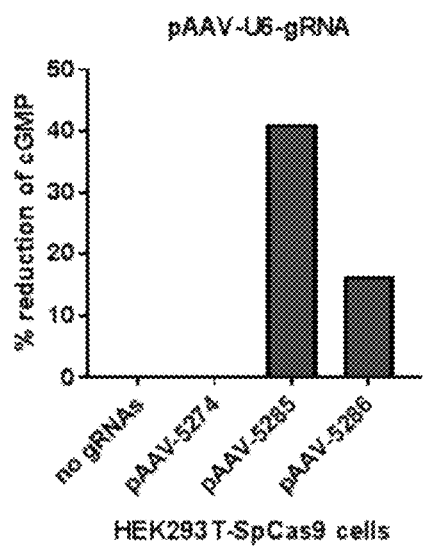
FIGS. 10A-B are graphs showing the percent reduction of cGMP and absolute cGMP for HEK293T-SpCas9 cells co-transfected with a vector containing R838H cDNA and pAAV-U6-R838 sgRNA that targets the R838H mutation within the GUCY2D gene.
Figure 10B:
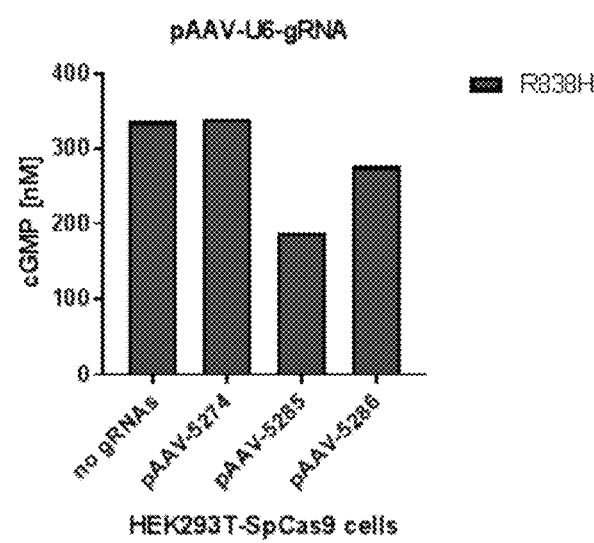

These data provide evidence that the tested gRNAs can effectively edit a GUCY2D gene containing the R838H mutation regardless of whether the gRNAs are synthetic gRNAs (FIGS. 8A-B and 9A-B), or AAV-encoded gRNAs (FIGS. 10A-B). Additionally, these data provide evidence that gRNAs of the present disclosure can reduce protein expression from the GUCY2D gene in support of at least the NHEJ editing strategy (FIGS. 8-10).

Example 27—Testing of Guide RNAs in Cells for Off-Target Activity

To determine the extent of off-target editing on a genomic level, the gRNAs (or sgRNAs) having the best on-target activity will then be tested for targeted-genome-wide off-target editing using GUIDE-seq, Amplicon-seq, and/or Dig-enome-seq. Off-target effects will be tested in human cells. This testing can enable selection of gRNAs with increased specficity.

Example 28—Testing Different Approaches for HDR Gene Editing

After testing the gRNAs for both on-target activity and off-target activity, mutation correction and knock-in strategies will be tested for HDR gene editing.

For the mutation correction approach, donor DNA template will be provided as a short single-stranded oligonucleotide, a short double-stranded oligonucleotide (PAM sequence intact/PAM sequence mutated), a long single-stranded DNA molecule (PAM sequence intact/PAM sequence mutated) or a long double-stranded DNA molecule (PAM sequence intact/PAM sequence mutated). In addition, the donor DNA template will be delivered by AAV.

For the cDNA knock-in approach, a single-stranded or double-stranded DNA having homologous arms to the GUCY2D chromosomal region can include more than 40 nt of the first exon (the first coding exon) of the GUCY2D gene, the complete CDS of the GUCY2D gene and 3' UTR of the GUCY2D gene, and at least 40 nt of the following intron. The single-stranded or double-stranded DNA having homologous arms to the GUCY2D chromosomal region can include more than 80 nt of the first exon of the GUCY2D gene, the complete CDS of the GUCY2D gene and 3' UTR of the GUCY2D gene, and at least 80 nt of the following intron. The single-stranded or double-stranded DNA having homologous arms to the GUCY2D chromosomal region can include more than 100 nt of the first exon of the GUCY2D gene, the complete CDS of the GUCY2D gene and 3' UTR of the GUCY2D gene, and at least 100 nt of the following intron. The single-stranded or double-stranded DNA having homologous arms to the GUCY2D chromosomal region can include more than 150 nt of the first exon of the GUCY2D gene, the complete CDS of the GUCY2D gene and 3' UTR of the GUCY2D gene, and at least 150 nt of the following intron. The single-stranded or double-stranded DNA having homologous arms to the GUCY2D chromosomal region can include more than 300 nt of the first exon of the GUCY2D gene, the complete CDS of the GUCY2D gene and 3' UTR of the GUCY2D gene, and at least 300 nt of the following intron. The single-stranded or double-stranded DNA having homologous arms to the GUCY2D chromosomal region can include more than 400 nt of the first exon of the GUCY2D gene, the complete CDS of the GUCY2D gene and 3' UTR of the GUCY2D gene, and at least 400 nt of the following intron.

Alternatively, the DNA template will be delivered by a recombinant AAV particle such as those taught herein.

A knock-in of GUCY2D cDNA can be performed into any selected chromosomal location or in one of the "safe harbor" locus, i.e., albumin gene, an AAVS 1 gene, an HRPT gene, a CCR5 gene, a globin gene, TTR gene, TF gene, F9 gene, Alb gene, Gys2 gene and PCSK9 gene. Assessment of efficiency of HDR mediated knock-in of cDNA into the first exon can utilize cDNA knock-in into "safe harbor" sites such as: single-stranded or double-stranded DNA having homologous arms to one of the following regions, for example: AAVS1 19q13.4-qter, HRPT 1q31.2, CCR5 3p21.31, Globin 11p15.4, TTR 18q12.1, TF 3q22.1, F9 Xq27.1, Alb 4q13.3, Gys2 12p12.1, PCSK9 1p32.3; 5'UTR correspondent to GUCY2D or alternative 5' UTR, complete CDS of GUCY2D and 3' UTR of GUCY2D or modified 3' UTR and at least 80 nt of the first intron, alternatively same DNA template sequence will be delivered by AAV.

These tests will allow for optimization of the various HDR gene editing strategies and comparisons based on their respective effectiveness will be made.

Example 29—Re-Assessment of Lead CRISPR-Cas9/DNA Donor Combinations

After testing the different strategies for gene editing, the lead CRISPR-Cas9/DNA donor combinations will be re-assessed in cells for efficiency of deletion, recombination, and off-target specificity. Cas9 mRNA or RNP will be formulated into lipid nanoparticles for delivery, sgRNAs will be formulated into nanoparticles or delivered as a recombinant AAV particle, and donor DNA will be formulated into nanoparticles or delivered as recombinant AAV particle. These tests will allow for further optimization of the various HDR gene editing strategies.

Example 30—Self-Inactivating (SIN) CRISPR-Cas Systems

When nucleic acids encoding Cas9 and/or guide RNA are delivered via viral vector, it can be advantageous to use a SIN vector to deliver at least one of the nucleic acids. Experiments were performed in order to further investigate the ability of various SIN vectors to edit targeted nucleic acids with specificity.

The three reporter cell lines described in Example 25 were used. The first reporter cell line has a wild-type GUCY2D gene (Cas9 target site) fused to a blue fluorescent protein (BFP) at the beta-tubulin gene locus. The second reporter cell line has a GUCY2D gene comprising a R838H mutation (Cas9 target site) fused to a BFP at the beta-tubulin gene locus. The third reporter cell line has a GUCY2D gene comprising a R838C mutation (Cas9 target site) fused to a BFP at the beta-tubulin gene locus. Thus, the Cas9 target site-BFP gene fusions comprised by the reporter cell lines can be used to report on editing activity at the Cas9 target site. The editing activity can cause loss of the BFP signal via a frameshift mutation. It was found that various combinations of Cas9 vectors and guide RNAs according to the present disclosure were effective in editing targeted GUCY2D R838H or R838C mutant Cas9 target sites. The various combinations were also specific such that editing of the wild-type GUCY2D Cas9 target sites was minimal and similar to background levels of BFP signal loss.

Each of the reporter cell lines was seeded in 2.5 ml of 10% FBS/DMEM at 500,000 cells per well in 6-well plates at 24 hours before transfection.

FIG. 12A shows results obtained when the reporter cell line having a wild-type GUCY2D gene (Cas9 target site) fused to a blue fluorescent protein at the beta-tubulin gene locus was transfected with 1.25 µg SIN-AAV SpCas9 ver. 1 (FIG. 11A) and 1.25 µg pSIA012 (FIG. 11D) using Lipofectamine® 3000. pSIA012 is a plasmid comprising an AAV sequence (SEQ ID NO: 5506) that encodes for R838H_Sp_T2 sgRNA (a sgRNA comprising SEQ ID NO: 5285) and EGFP. SIN-AAV SpCas9 ver. 1 encodes SpCas9 and includes SIN sites (also called R838 target sites) located 5' (SEQ ID NO: 5478) and 3' (SEQ ID NO: 5480) of the SpCas9 ORF. The 5' SIN site (SEQ ID NO: 5478) in SIN-AAV SpCas9 ver. 1 comprises SEQ ID NO: 5327, which is targeted by sgRNA comprising SEQ ID NO: 5285. The 3' SIN site (SEQ ID NO: 5480) in SIN-AAV SpCas9 ver. 1 comprises SEQ ID NO: 5369, which is also targeted by sgRNA comprising SEQ ID NO: 5285 (Table 9).

Table 9

SIN-AAV SpCas9 Ver.1 Comprising Two SIN Sites Targeted by a sgRNA Comprising SEQ ID NO: 5285

TABLE 9

SIN-AAV SpCas9 ver.1 comprising two SIN sites targeted by a sgRNA comprising SEQ ID NO: 5285

| Sequence Type | SEQ ID NO: | Sequences |
| --- | --- | --- |
| 5' SIN site sequence | 5478 | ggaggatctgatccggga gcacacggaggagctgga |
| Target sequence | 5327 | ggatctgatccgggagca ca |
| 3' SIN site sequence | 5480 | tccagctcctccgtgtgc tcccggatcagatcctcc |
| Target sequence | 5369 | tgtgctcccggatcagat cc |

The reporter cell line having a GUCY2D gene comprising a R838H mutation (Cas9 target site) fused to a blue fluorescent protein at the beta-tubulin gene locus was transfected with 1.25 µg SIN-AAV SpCas9 ver. 1 and 1.25 µg pSIA012 using Lipofectamine® 3000 (FIG. 12C).

The reporter cell line having a GUCY2D gene comprising a R838C mutation (Cas9 target site) fused to a blue fluorescent protein at the beta-tubulin gene locus was transfected with 1.25 µg SIN-AAV SpCas9 ver. 1 and 1.25 µg pSIA012 using Lipofectamine® 3000 (FIG. 12E).

FIG. 12B shows results obtained when the reporter cell line having a wild-type GUCY2D gene (Cas9 target site) fused to a blue fluorescent protein at the beta-tubulin gene locus was transfected with 1.25 µg SIN-AAV SpCas9 ver. 1 (FIG. 11A) and 1.25 µg pSIA015 (FIG. 11D) using Lipofectamine® 3000. pSIA015 is a plasmid comprising an AAV sequence (SEQ ID NO: 5507) that encodes for R838CH_Sp_T1 sgRNA (a sgRNA comprising SEQ ID NO: 5398) and EGFP. SIN-AAV SpCas9 ver. 1 encodes SpCas9 and includes SIN sites (also called R838 target sites) located 5' (SEQ ID NO: 5478) and 3' (SEQ ID NO: 5480) of the SpCas9 ORF. The 5' SIN site (SEQ ID NO: 5478) in SIN-AAV SpCas9 ver. 1 comprises SEQ ID NO: 5326, which is targeted by sgRNA comprising SEQ ID NO: 5398. The 3' SIN site (SEQ ID NO: 5480) in SIN-AAV SpCas9 ver. 1 comprises SEQ ID NO: 5368, which is targeted by sgRNA comprising SEQ ID NO: 5398 (Table 10).

TABLE 10

SIN-AAV SpCas9 ver.1 comprising two SIN sites targeted by a sgRNA comprising SEQ ID NO: 5398

| Sequence Type | SEQ ID NO: | Sequences |
|---|---|---|
| 5' SIN site sequence | 5478 | ggaggatctgatccgggagcacacggaggagctgga |
| Target sequence | 5326 | tctgatccgggagcacacgg |
| 3' SIN site sequence | 5480 | tccagctcctccgtgtgctcccggatcagatcctcc |
| Target sequence | 5368 | ccgtgtgctcccggatcaga |

The reporter cell line having a GUCY2D gene comprising a R838H mutation (Cas9 target site) fused to a blue fluorescent protein at the beta-tubulin gene locus was transfected with 1.25 µg SIN-AAV SpCas9 ver. 1 and 1.25 µg pSIA015 using Lipofectamine® 3000 (FIG. 12D).

The reporter cell line having a GUCY2D gene comprising a R838C mutation (Cas9 target site) fused to a blue fluorescent protein at the beta-tubulin gene locus was transfected with 1.25 µg SIN-AAV SpCas9 ver. 1 and 1.25 µg pSIA015 using Lipofectamine® 3000 (FIG. 12F).

FIG. 12G shows results obtained when the reporter cell line having a wild-type GUCY2D gene (Cas9 target site) fused to a blue fluorescent protein at the beta-tubulin gene locus was transfected with 1.25 µg SIN-AAV SpCas9 ver. 2 (FIG. 11B) and 1.25 µg pSIA012 (FIG. 11D) using Lipofectamine® 3000. SIN-AAV SpCas9 ver. 2 encodes SpCas9 and includes SIN sites located 5' (SEQ ID NO: 5479) and 3' (SEQ ID NO: 5480) of the SpCas9 ORF. The 5' SIN site (SEQ ID NO: 5479) in SIN-AAV SpCas9 ver. 2 comprises SEQ ID NO: 5327, which is targeted by sgRNA comprising SEQ ID NO: 5285. The 3' SIN site (SEQ ID NO: 5480) in SIN-AAV SpCas9 ver. 2 comprises SEQ ID NO: 5369, which is targeted by sgRNA comprising SEQ ID NO: 5285 (Table 11).

TABLE 11

SIN-AAV SpCas9 ver.2 comprising two SIN sites targeted by a sgRNA comprising SEQ ID NO: 5285

| Sequence Type | SEQ ID NO: | Sequences |
|---|---|---|
| 5' SIN site sequence | 5479 | aggatctgatccgggagcacacggaggagctgga |
| Target sequence | 5327 | ggatctgatccgggagcaca |
| 3' SIN site sequence | 5480 | tccagctcctccgtgtgctcccggatcagatcctcc |
| Target sequence | 5369 | tgtgctcccggatcagatcc |

The reporter cell line having a GUCY2D gene comprising a R838H mutation (Cas9 target site) fused to a blue fluorescent protein at the beta-tubulin gene locus was transfected with 1.25 µg SIN-AAV SpCas9 ver. 2 and 1.25 µg pSIA012 using Lipofectamine® 3000 (FIG. 12I).

The reporter cell line having a GUCY2D gene comprising a R838C mutation (Cas9 target site) fused to a blue fluorescent protein at the beta-tubulin gene locus was transfected with 1.25 µg SIN-AAV SpCas9 ver. 2 and 1.25 µg pSIA012 using Lipofectamine® 3000 (FIG. 12K).

FIG. 12H shows results obtained when the reporter cell line having a wild-type GUCY2D gene (Cas9 target site) fused to a blue fluorescent protein at the beta-tubulin gene locus was transfected with 1.25 µg SIN-AAV SpCas9 ver. 2 (FIG. 11B) and 1.25 µg pSIA015 (FIG. 11D) using Lipofectamine® 3000. SIN-AAV SpCas9 ver. 2 encodes SpCas9 and includes SIN sites located 5' (SEQ ID NO: 5479) and 3' (SEQ ID NO: 5480) of the SpCas9 ORF. The 5' SIN site (SEQ ID NO: 5479) in SIN-AAV SpCas9 ver. 2 comprises SEQ ID NO: 5326, which is targeted by sgRNA comprising SEQ ID NO: 5398. The 3' SIN site (SEQ ID NO: 5480) in SIN-AAV SpCas9 ver. 2 comprises SEQ ID NO: 5368, which is targeted by sgRNA comprising SEQ ID NO: 5398 (Table 12).

TABLE 12

SIN-AAV SpCas9 ver.2 comprising two SIN sites targeted by a sgRNA comprising SEQ ID NO: 5398

| Sequence Type | SEQ ID NO: | Sequences |
|---|---|---|
| 5' SIN site sequence | 5479 | aggatctgatccgggagcacacggaggagctgga |
| Target sequence | 5326 | tctgatccgggagcacacgg |
| 3' SIN site sequence | 5480 | tccagctcctccgtgtgctcccggatcagatcctcc |
| Target sequence | 5368 | ccgtgtgctcccggatcaga |

The reporter cell line having a GUCY2D gene comprising a R838H mutation (Cas9 target site) fused to a blue fluorescent protein at the beta-tubulin gene locus was transfected with 1.25 µg SIN-AAV SpCas9 ver. 2 and 1.25 µg pSIA015 using Lipofectamine® 3000 (FIG. 12J).

The reporter cell line having a GUCY2D gene comprising a R838C mutation (Cas9 target site) fused to a blue fluorescent protein at the beta-tubulin gene locus was transfected with 1.25 µg SIN-AAV SpCas9 ver. 2 and 1.25 µg pSIA015 using Lipofectamine® 3000 (FIG. 12L).

FIG. 12M shows results obtained when the reporter cell line having a wild-type GUCY2D gene (Cas9 target site) fused to a blue fluorescent protein at the beta-tubulin gene locus was transfected with 1.25 µg Non-SIN-AAV SpCas9 (FIG. 11C) and 1.25 µg pSIA012 (FIG. 11D) using Lipofectamine® 3000. Non-SIN-AAV SpCas9 encodes SpCas9 and includes no SIN sites (also called R838 target sites).

The reporter cell line having a GUCY2D gene comprising a R838H mutation (Cas9 target site) fused to a blue fluorescent protein at the beta-tubulin gene locus was transfected with 1.25 µg Non-SIN-AAV SpCas9 and 1.25 µg pSIA012 using Lipofectamine® 3000 (FIG. 12P).

The reporter cell line having a GUCY2D gene comprising a R838C mutation (Cas9 target site) fused to a blue fluorescent protein at the beta-tubulin gene locus was transfected with 1.25 µg Non-SIN-AAV SpCas9 and 1.25 µg pSIA012 using Lipofectamine® 3000 (FIG. 12S).

FIG. 12N shows results obtained when the reporter cell line having a wild-type GUCY2D gene (Cas9 target site) fused to a blue fluorescent protein at the beta-tubulin gene locus was transfected with 1.25 µg Non-SIN-AAV SpCas9 (FIG. 11C) and 1.25 µg pSIA015 (FIG. 11D) using Lipofectamine® 3000.

The reporter cell line having a GUCY2D gene comprising a R838H mutation (Cas9 target site) fused to a blue fluorescent protein at the beta-tubulin gene locus was transfected with 1.25 µg Non-SIN-AAV SpCas9 and 1.25 µg pSIA015 using Lipofectamine® 3000 (FIG. 12Q).

The reporter cell line having a GUCY2D gene comprising a R838C mutation (Cas9 target site) fused to a blue fluorescent protein at the beta-tubulin gene locus was transfected with 1.25 µg Non-SIN-AAV SpCas9 and 1.25 µg pSIA015 using Lipofectamine® 3000 (FIG. 12T).

The reporter cell line having a wild-type GUCY2D gene (Cas9 target site) fused to a blue fluorescent protein at the beta-tubulin gene locus was transfected with only transfection reagent (no DNA) using Lipofectamine® 3000 (FIG. 12O).

The reporter cell line having a GUCY2D gene comprising a R838H mutation (Cas9 target site) fused to a blue fluorescent protein at the beta-tubulin gene locus was transfected with only transfection reagent (no DNA) using Lipofectamine® 3000 (FIG. 12R).

The reporter cell line having a GUCY2D gene comprising a R838C mutation (Cas9 target site) fused to a blue fluorescent protein at the beta-tubulin gene locus was transfected with only transfection reagent (no DNA) using Lipofectamine® 3000 (FIG. 12U).

At 72 hours post-transfection, reporter cells were dissociated from the plates by incubation with trypsin-EDTA, and analyzed for blue fluorescence (BFP) and green fluorescence (GFP) by flow cytometry. A frame-shift induced by genome editing at a Cas9 target site (whether the Cas9 target site is the wild-type GUCY2D gene, the GUCY2D gene comprising the R838H mutation, or the GUCY2D gene comprising the R838C mutation) of the HEK 293FT cell results in loss of BFP. EGFP and sgRNA are encoded on the same vector and the EGFP serves as a transfection marker. Therefore, HEK 293FT cells transfected with pSIA012 (which comprises an AAV sequence that encodes R838H_Sp_T2 sgRNA—a sgRNA comprising SEQ ID NO: 5285) or pSIA015 (which comprises an AAV sequence that encodes R838CH_Sp_T1 sgRNA—a sgRNA comprising SEQ ID NO: 5398) are GFP positive.

Gene editing in the transfected cells was estimated in the cell populations plotted within a gate (FIGS. 12A-12U). The bolded percentages in FIGS. 12A-12U indicate BFP negative and GFP positive cells within the gate. BFP negative means that gene editing occurred at the Cas9 target site of these transfected HEK 293FT cells. GFP positive means that these transfected HEK 293FT cells contain a plasmid that encodes EGFP and sgRNA.

FIG. 12A shows that of the transfected HEK 293FT reporter cells that have the wild-type GUCY2D gene as the Cas9 target site in the gate, 9.63% of these cells had the wild-type GUCY2D gene edited when transfected with SIN-AAV SpCas9 ver. 1 and pSIA012, which encodes R838H_Sp_T2 sgRNA (sgRNA comprising SEQ ID NO: 5285).

FIG. 12B shows that of the transfected HEK 293FT reporter cells that have the wild-type GUCY2D gene as the Cas9 target site in the gate, ~0% of these cells had the wild-type GUCY2D gene edited when transfected with SIN-AAV SpCas9 ver. 1 and pSIA015, which encodes R838CH_Sp_T1 sgRNA (sgRNA comprising SEQ ID NO: 5398).

FIG. 12C shows that of the transfected HEK 293FT reporter cells that have the R838H mutation as the Cas9 target site in the gate, 53.07% of these cells had the R838H mutation edited when transfected with SIN-AAV SpCas9 ver. 1 and pSIA012.

FIG. 12D shows that of the transfected HEK 293FT reporter cells that have the R838H mutation as the Cas9 target site in the gate, 21.04% of these cells had the R838H mutation edited when transfected with SIN-AAV SpCas9 ver. 1 and pSIA015.

FIG. 12E shows that of the transfected HEK 293FT reporter cells that have the R838C mutation as the Cas9 target site in the gate, ~0% of these cells had the R838C mutation edited when transfected with SIN-AAV SpCas9 ver. 1 and pSIA012.

FIG. 12F shows that of the transfected HEK 293FT reporter cells that have the R838C mutation as the Cas9 target site in the gate, 26.35% of these cells had the R838C mutation edited when transfected with SIN-AAV SpCas9 ver. 1 and pSIA015.

FIG. 12G shows that of the transfected HEK 293FT reporter cells that have the wild-type GUCY2D gene as the Cas9 target site in the gate, 7.43% of these cells had the wild-type GUCY2D gene edited when transfected with SIN-AAV SpCas9 ver. 2 and pSIA012.

FIG. 12H shows that of the transfected HEK 293FT reporter cells that have the wild-type GUCY2D gene as the Cas9 target site in the gate, ~0% of these cells had the wild-type GUCY2D gene edited when transfected with SIN-AAV SpCas9 ver. 2 and pSIA015.

FIG. 12I shows that of the transfected HEK 293FT reporter cells that have the R838H mutation as the Cas9 target site in the gate, 52.62% of these cells had the R838H mutation edited when transfected with SIN-AAV SpCas9 ver. 2 and pSIA012.

FIG. 12J shows that of the transfected HEK 293FT reporter cells that have the R838H mutation as the Cas9 target site in the gate, 18.50% of these cells had the R838H mutation edited when transfected with SIN-AAV SpCas9 ver. 2 and pSIA015.

FIG. 12K shows that of the transfected HEK 293FT reporter cells that have the R838C mutation as the Cas9 target site in the gate, ~0% of these cells had the R838C mutation edited when transfected with SIN-AAV SpCas9 ver. 2 and pSIA012.

FIG. 12L shows that of the transfected HEK 293FT reporter cells that have the R838C mutation as the Cas9 target site in the gate, 24.73% of these cells had the R838C mutation edited when transfected with SIN-AAV SpCas9 ver. 2 and pSIA015.

FIG. 12M shows that of the transfected HEK 293FT reporter cells that have the wild-type GUCY2D gene as the Cas9 target site in the gate, 13.51% of these cells had the wild-type GUCY2D gene edited when transfected with Non-SIN-AAV SpCas9 and pSIA012.

FIG. 12N shows that of the transfected HEK 293FT reporter cells that have the wild-type GUCY2D gene as the Cas9 target site in the gate, ~0% of these cells had the wild-type GUCY2D gene edited when transfected with Non-SIN-AAV SpCas9 and pSIA015.

FIG. 12O shows that of the transfected HEK 293FT reporter cells that have the wild-type GUCY2D gene as the Cas9 target site in the gate, 0% of these cells had the wild-type GUCY2D gene edited when no DNA was used.

FIG. 12P shows that of the transfected HEK 293FT reporter cells that have the R838H mutation as the Cas9 target site in the gate, 50.34% of these cells had the R838H mutation edited when transfected with Non-SIN-AAV SpCas9 and pSIA012.

FIG. 12Q shows that of the transfected HEK 293FT reporter cells that have the R838H mutation as the Cas9 target site in the gate, 20.62% of these cells had the R838H mutation edited when transfected with Non-SIN-AAV SpCas9 and pSIA015.

FIG. 12R shows that of the transfected HEK 293FT reporter cells that have the R838H mutation as the Cas9 target site in the gate, 0% of these cells had the R838H mutation edited when no DNA was used.

FIG. 12S shows that of the transfected HEK 293FT reporter cells that have the R838C mutation as the Cas9 target site in the gate, ~0% of these cells had the R838C mutation edited when transfected with Non-SIN-AAV SpCas9 and pSIA012.

FIG. 12T shows that of the transfected HEK 293FT reporter cells that have the R838C mutation as the Cas9 target site in the gate, 29.17% of these cells had the R838C mutation edited when transfected with Non-SIN-AAV SpCas9 and pSIA015.

FIG. 12U shows that of the transfected HEK 293FT reporter cells that have the R838C mutation as the Cas9 target site in the gate, 0% of these cells had the R838C mutation edited when no DNA was used.

Since no genome editing was induced in mock transfected cells, the vast majority of mock transfected cells are BFP positive (FIGS. 12O, 12R, and 12U).

The results reported in FIGS. 12A-U provide evidence that the SIN vectors of the present disclosure can edit genomic target alleles with specificity.

To determine the ability of SIN vectors to limit Cas9 expression, the expression levels of Cas9 protein were measured by immunoblot (FIGS. 13A-C) for the cells used in the experiments described by FIGS. 12A-U.

At 72 hours post-transfection, reporter cells were also harvested in PBS, and total protein was extracted in 0.1% Triton X-100/TBS (25 mM Tris-HCl (pH 7.5) and 150 mM NaCl). Five micrograms of total protein was separated on NUPAGE 4-12% polyacrylamide/Tris-Bis gels, and transferred onto nitrocellulose membranes. SpCas9, EGFP (as a transfection control) and beta actin (as an internal control) were detected using a Cas9 monoclonal antibody, GFP Tag polyclonal antibody, and beta actin loading control monoclonal antibody, respectively.

Figure 13A:
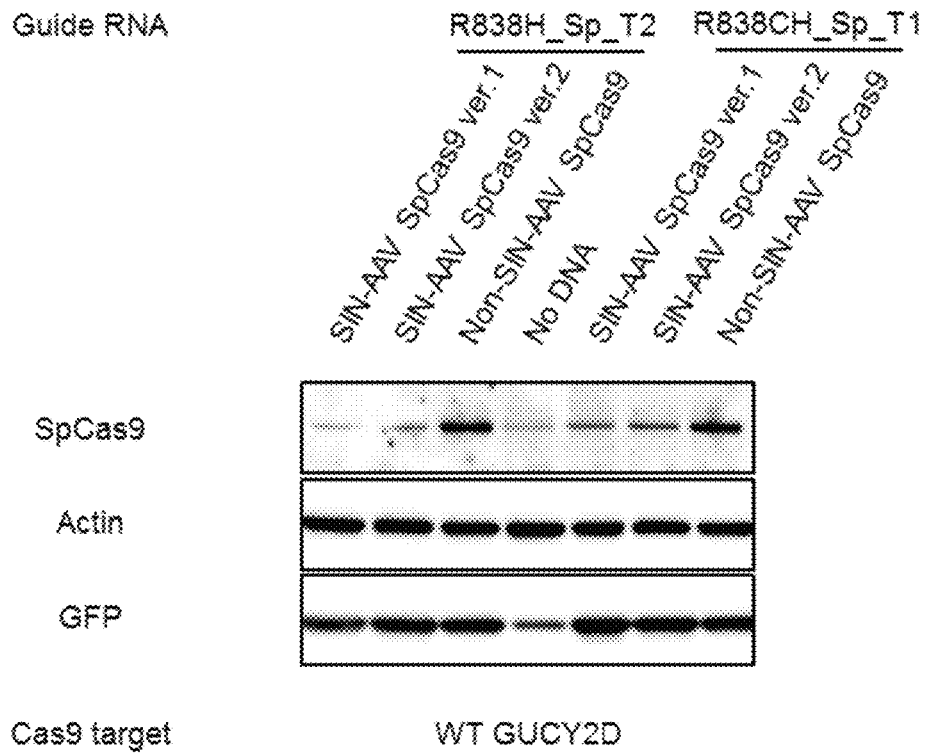
FIGS. 13A-C show western blot data for 3 different HEK 293FT reporter cell lines that are co-transfected with either pSIA012, a plasmid comprising an AAV sequence that encodes R838H_Sp_T2 sgRNA (a sgRNA comprising SEQ ID NO: 5285) or pSIA015, a plasmid comprising an AAV sequence that encodes R838CH_Sp_T1 sgRNA (a sgRNA comprising SEQ ID NO: 5398) and either (1) a SIN-AAV SpCas9 version 1 (sEF1α promoter), (2) a SIN-AAV SpCas9 version 2 (sEF1α promoter), or (3) a Non-SIN-AAV SpCas9 (sEF1α promoter).

FIG. 13A (lane 1) shows Cas9 inactivation in HEK 293FT reporter cells that have the wild-type GUCY2D gene as the Cas9 target site and that were transfected with SIN-AAV SpCas9 ver. 1 (FIG. 11A) and pSIA012, which encodes R838H_Sp_T2 sgRNA (sgRNA comprising SEQ ID NO: 5285).

FIG. 13A (lane 2) shows Cas9 inactivation in HEK 293FT reporter cells that have the wild-type GUCY2D gene as the Cas9 target site and that were transfected with SIN-AAV SpCas9 ver. 2 (FIG. 11B) and pSIA012.

FIG. 13A (lane 3) shows Cas9 expression in HEK 293FT reporter cells that have the wild-type GUCY2D gene as the Cas9 target site and that were transfected with Non-SIN-AAV SpCas9 (FIG. 11C) and pSIA012.

FIG. 13A (lane 4) shows no Cas9 expression in HEK 293FT reporter cells that have the wild-type GUCY2D gene as the Cas9 target site and that were not transfected with any DNA.

FIG. 13A (lane 5) shows Cas9 inactivation in HEK 293FT reporter cells that have the wild-type GUCY2D gene as the Cas9 target site and that were transfected with SIN-AAV SpCas9 ver. 1 (FIG. 11A) and pSIA015, which encodes R838CH_Sp_T1 sgRNA (sgRNA comprising SEQ ID NO: 5398).

FIG. 13A (lane 6) shows Cas9 inactivation in HEK 293FT reporter cells that have the wild-type GUCY2D gene as the Cas9 target site and that were transfected with SIN-AAV SpCas9 ver. 2 (FIG. 11B) and pSIA015.

FIG. 13A (lane 7) shows Cas9 expression in HEK 293FT reporter cells that have the wild-type GUCY2D gene as the Cas9 target site and that were transfected with Non-SIN-AAV SpCas9 (FIG. 11C) and pSIA015.

Figure 13B:
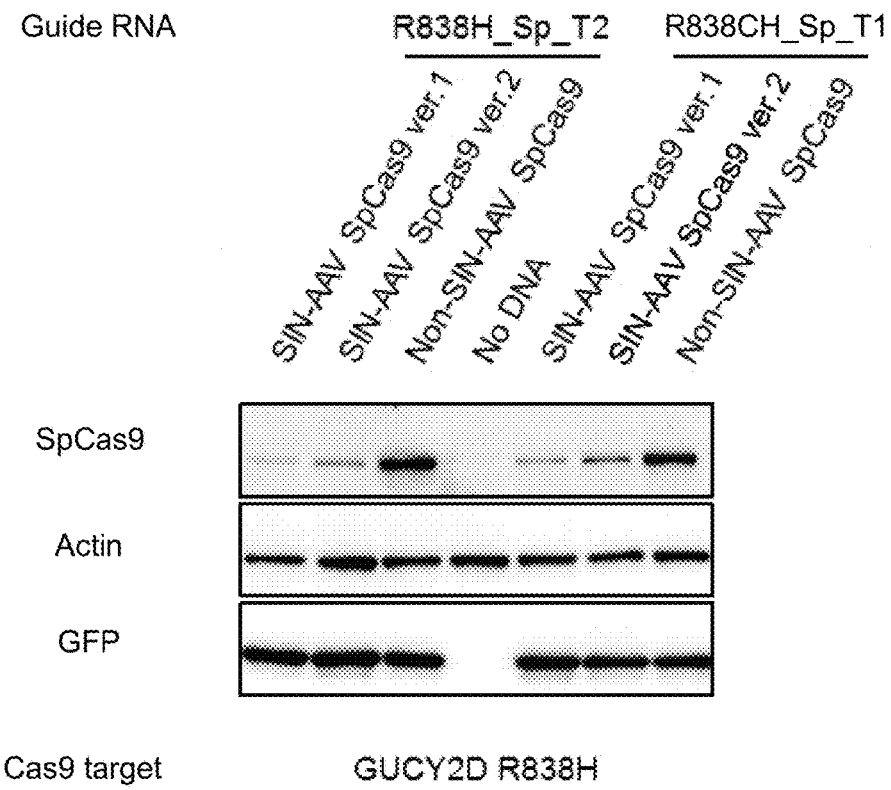

FIG. 13B (lane 1) shows Cas9 inactivation in HEK 293FT reporter cells that have the R838H mutation as the Cas9 target site and that were transfected with SIN-AAV SpCas9 ver. 1 (FIG. 11A) and pSIA012, which encodes R838H_Sp_T2 sgRNA (sgRNA comprising SEQ ID NO: 5285).

FIG. 13B (lane 2) shows Cas9 inactivation in HEK 293FT reporter cells that have the R838H mutation as the Cas9 target site and that were transfected with SIN-AAV SpCas9 ver. 2 (FIG. 11B) and pSIA012.

FIG. 13B (lane 3) shows Cas9 expression in HEK 293FT reporter cells that have the R838H mutation as the Cas9 target site and that were transfected with Non-SIN-AAV SpCas9 (FIG. 11C) and pSIA012.

FIG. 13B (lane 4) shows no Cas9 expression in HEK 293FT reporter cells that have the R838H mutation as the Cas9 target site and that were not transfected with any DNA.

FIG. 13B (lane 5) shows Cas9 inactivation in HEK 293FT reporter cells that have the R838H mutation as the Cas9 target site and that were transfected with SIN-AAV SpCas9 ver. 1 (FIG. 11A) and pSIA015, which encodes R838CH_Sp_T1 sgRNA (sgRNA comprising SEQ ID NO: 5398).

FIG. 13B (lane 6) shows Cas9 inactivation in HEK 293FT reporter cells that have the R838H mutation as the Cas9 target site and that were transfected with SIN-AAV SpCas9 ver. 2 (FIG. 11B) and pSIA015.

FIG. 13B (lane 7) shows Cas9 expression in HEK 293FT reporter cells that have the R838H mutation as the Cas9 target site and that were transfected with Non-SIN-AAV SpCas9 (FIG. 11C) and pSIA015.

Figure 13C:
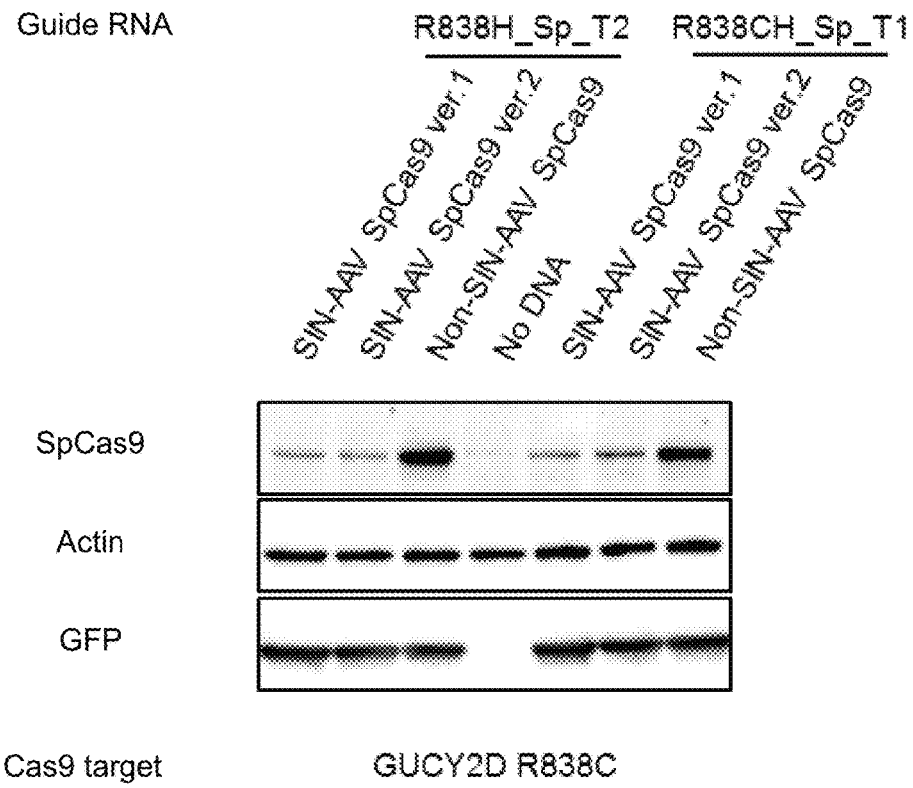

FIG. 13C (lane 1) shows Cas9 inactivation in HEK 293FT reporter cells that have the R838C mutation as the Cas9 target site and that were transfected with SIN-AAV SpCas9 ver. 1 (FIG. 11A) and pSIA012, which encodes R838H_Sp_T2 sgRNA (sgRNA comprising SEQ ID NO: 5285).

FIG. 13C (lane 2) shows Cas9 inactivation in HEK 293FT reporter cells that have the R838C mutation as the Cas9 target site and that were transfected with SIN-AAV SpCas9 ver. 2 (FIG. 11B) and pSIA012.

FIG. 13C (lane 3) shows Cas9 expression in HEK 293FT reporter cells that have the R838C mutation as the Cas9 target site and that were transfected with Non-SIN-AAV SpCas9 (FIG. 11C) and pSIA012.

FIG. 13C (lane 4) shows no Cas9 expression in HEK 293FT reporter cells that have the R838C mutation as the Cas9 target site and that were not transfected with any DNA.

FIG. 13C (lane 5) shows Cas9 inactivation in HEK 293FT reporter cells that have the R838C mutation as the Cas9 target site and that were transfected with SIN-AAV SpCas9 ver. 1 (FIG. 11A) and pSIA015, which encodes R838CH_Sp_T1 sgRNA (sgRNA comprising SEQ ID NO: 5398).

FIG. 13C (lane 6) shows Cas9 inactivation in HEK 293FT reporter cells that have the R838C mutation as the Cas9 target site and that were transfected with SIN-AAV SpCas9 ver. 2 (FIG. 11B) and pSIA015.

FIG. 13C (lane 7) shows Cas9 expression in HEK 293FT reporter cells that have the R838C mutation as the Cas9 target site and that were transfected with Non-SIN-AAV SpCas9 (FIG. 11C) and pSIA015.

To confirm that introduced SIN sites do not influence transcription and translation of Cas9, HEK 293FT cells were transfected with 1.25 μg of pDL107 (which encodes GFP and does not encode sgRNA) and either (1) SIN-AAV SpCas9 ver. 1, (2) SIN-AAV SpCas9 ver. 2, or (3) Non-SIN-AAV SpCas9. Cells were seeded in 2.5 ml of 10% FBS/DMEM at 500,000 cells per well in 6-well plates at 24 hours before transfection. At 72 hours after transfection, GFP expression of all the transfected cells were analyzed by flow cytometry, and total protein was extracted in 0.1% Triton X-100/TBS (25 mM Tris-HCl (pH 7.5) and 150 mM NaCl). Five micrograms of total protein was separated on a NUPAGE 4-12% polyacrylamide/Tris-Bis gel, and transferred onto nitrocellulose membranes. SpCas9, EGFP (as a transfection control) and beta actin (as an internal control) were detected using a Cas9 monoclonal antibody, GFP Tag polyclonal antibody and beta actin loading control monoclonal antibody, respectively. Results showed that there was equal SpCas9 expression in HEK 293FT cells transfected with (1) SIN-AAV SpCas9 ver. 1, (2) SIN-AAV SpCas9 ver. 2, and (3) Non-SIN-AAV SpCas9 (Data not shown).

SIN Cas9 vectors showed decreased expression of Cas9 in all three reproter cell lines when targeted by either a guide RNA comprising SEQ ID NO: 5285 or 5398, thus providing evidence that SIN vectors of the present disclosure can limit expression of Cas9 protein (FIGS. 13A-C), while still causing editing of targeted alleles (FIGS. 12A-U).

Example 31—Self-Inactivating (SIN) CRISPR-Cas Systems

Figure 15A:
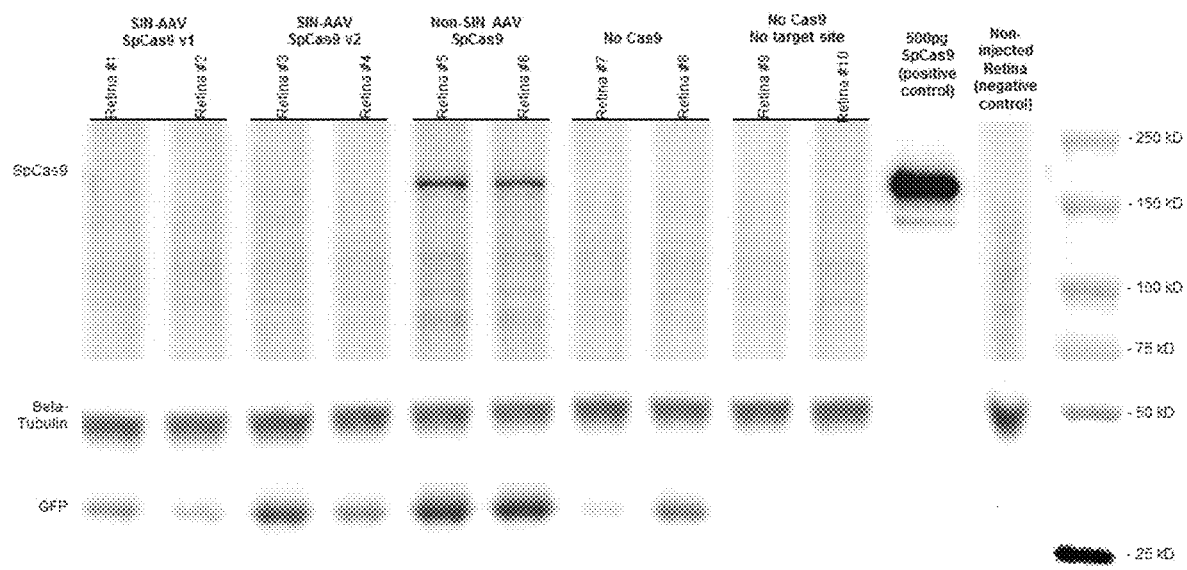
FIGS. 15A-B are western blots showing SpCas9, Beta-Tubulin, and GFP expression in cells isolated from mouse retinas that were previously injected with either an AAV that encodes R838H_Sp_T2 sgRNA (a sgRNA comprising SEQ ID NO: 5285) or AAV that encodes R838CH_Sp_T1 sgRNA (a sgRNA comprising SEQ ID NO: 5398). Mouse retinas were co-injected with AAV-R838H (SEQ ID NO: 5481) and either (1) a SIN-AAV SpCas9 version 1 (GRK1), (2) a SIN-AAV SpCas9 version 2 (GRK1), or (3) a Non-SIN-AAV SpCas9 (GRK1).
Figure 15B:
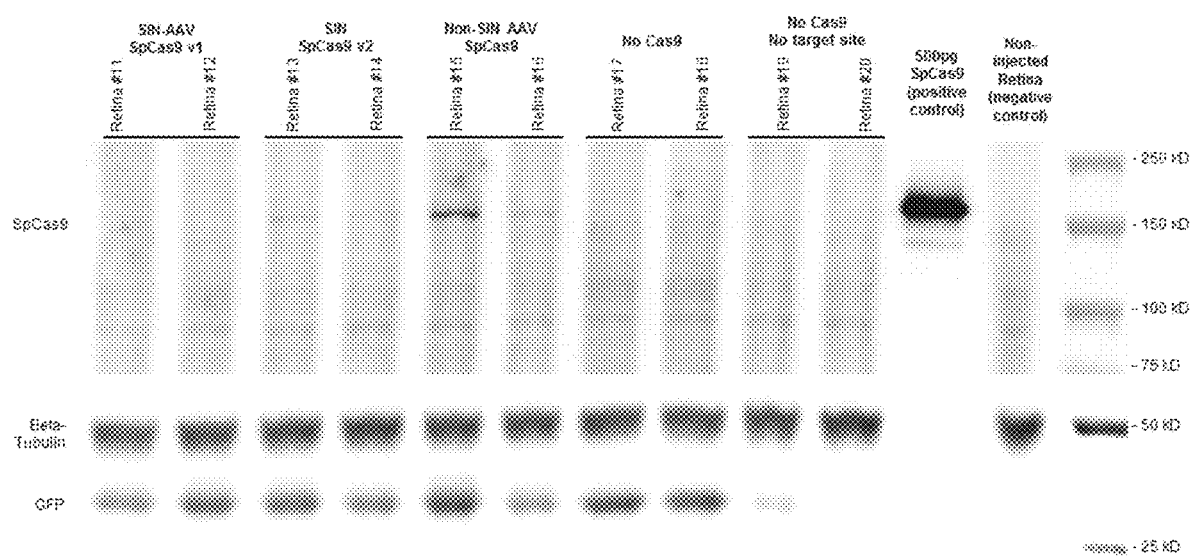

To determine the ability of SIN vectors to limit Cas9 expression in vivo, the expression levels of Cas9 protein were measured by immunoblot in mouse retinas isolated 28 days after subretinal AAV injection (FIGS. 15A-B).

Eight to ten-week-old C57BL/6J mice were purchased from Jackson Laboratories and maintained at MisoPro Animal Facility (Cambridge, Mass.). All animal procedures were conducted in compliance with the Animal Welfare Act, and the Guide for the Care and Use of Laboratory Animals, the Office of Laboratory Animal Welfare and in accordance with the Association for Research in Vision and Ophthalmology (ARVO) Statement for the Use of Animals in Ophthalmic and Vision Research.

AAVs were delivered by subretinal injection [$2\times10^9$ genome copies (GC) for each vector] into the wild-type mice following standard subretinal injection procedure. There were 10 different AAV groups delivered by subretinal injection. The first group included: SIN-AAV SpCas9 ver. 1 (FIG. 14A), AAV-R838H_Sp_T2 sgRNA, and an AAV comprising a R838H mutation within the GUCY2D gene. FIG. 11D shows the structural arrangement of an AAV sequence located within pSIA012, a plasmid that is used to generate AAV-R838H_Sp_T2 sgRNA. AAV-R838H_Sp_T2 sgRNA encodes a sgRNA comprising SEQ ID NO: 5285. The second group included: SIN-AAV SpCas9 ver. 2 (FIG. 14B), AAV-R838H_Sp_T2 sgRNA, and an AAV comprising a R838H mutation within the GUCY2D gene. The third group included: Non-SIN-AAV SpCas9 (FIG. 14C), AAV-R838H_Sp_T2 sgRNA, and an AAV comprising a R838H mutation within the GUCY2D gene. The fourth group included: AAV-R838H_Sp_T2 sgRNA and an AAV comprising a R838H mutation within the GUCY2D gene. The fifth group included: AAV-R838H_Sp_T2 sgRNA. The sixth group included: SIN-AAV SpCas9 ver. 1 (FIG. 14A), AAV R838CH_Sp_T1 sgRNA, and an AAV comprising a R838H mutation within the GUCY2D gene. FIG. 11D shows the structural arrangement of an AAV sequence located within pSIA015, a plasmid that is used to generate AAV-R838CH_Sp_T1 sgRNA. AAV-R838CH_Sp_T1 sgRNA encodes a sgRNA comprising SEQ ID NO: 5398. The seventh group included: SIN-AAV SpCas9 ver. 2 (FIG. 14B), AAV R838CH_Sp_T1 sgRNA, and an AAV comprising a R838H mutation within the GUCY2D gene. The eighth group included: Non-SIN-AAV SpCas9 (FIG. 14C), AAV R838CH_Sp_T1 sgRNA, and an AAV comprising a R838H mutation within the GUCY2D gene. The ninth group included: AAV R838CH_Sp_T1 sgRNA and an AAV comprising a R838H mutation within the GUCY2D gene. The tenth group included: AAV R838CH_Sp_T1 sgRNA.

On Day 28 post AAV injection, mouse retinas were isolated using micro-dissecting scissors under a dissection microscope. The retinal pigment epithelium (RPE) layer was carefully removed. Cells were lysed in RIPA lysis buffer (Thermo Fisher Scientific) supplemented with Halt Protease Inhibitor cocktail on ice. Protein quantification was measured by Pierce BCA assay (Thermo Fisher Scientific).

Protein per retina sample was separated using the NuPAGE Electrophoresis System (Thermo Fisher Scientific), after which the proteins were transferred using 0.45 um Pore Size Nitrocellulose Membrane Filter Paper Sandwich (Thermo Fisher Scientific). Blocking buffer with Pierce TBST (Tris-buffered saline with Tween 20 detergent) buffer containing 5% (w/v) BSA was prepared. Membranes were blocked by Pierce TBST (Tris-buffered saline with Tween 20 detergent) buffer containing 5% (w/v) BSA at room temperature for 2 hours, or 4° C. overnight. The membranes were then incubated with a primary antibody by diluting the antibody with blocking buffer and incubating the membrane on a rocker at 4° C. overnight. After three washes, the membrane was incubated with secondary antibodies at 1:5000 at RT for 1 hour. Imaging was obtained with ChemiDoc™ MP Imaging System (BioRad).

FIG. 15A (lanes 1-2) shows Cas9 inactivation in retinas (without RPE) that were transfected with SIN-AAV SpCas9 ver. 1, AAV R838H_Sp_T2 sgRNA, and an AAV comprising a R838H mutation within the GUCY2D gene.

FIG. 15A (lanes 3-4) shows Cas9 inactivation in retinas (without RPE) that were transfected with SIN-AAV SpCas9 ver. 2, AAV R838H_Sp_T2 sgRNA, and an AAV comprising a R838H mutation within the GUCY2D gene.

FIG. 15A (lanes 5-6) shows Cas9 expression in retinas (without RPE) that were transfected with Non-SIN-AAV SpCas9, AAV R838H_Sp_T2 sgRNA, and an AAV comprising a R838H mutation within the GUCY2D gene.

FIG. 15A (lanes 7-8) shows no Cas9 expression in retinas (without RPE) that were transfected with AAV R838H_Sp_T2 sgRNA, and an AAV comprising a R838H mutation within the GUCY2D gene.

FIG. 15A (lanes 9-10) shows no Cas9 expression in retinas (without RPE) that were transfected with only AAV R838H_Sp_T2 sgRNA.

FIG. 15B (lanes 1-2) shows Cas9 inactivation in retinas (without RPE) that were transfected with SIN-AAV SpCas9 ver. 1, AAV R838CH_Sp_T1 sgRNA, and an AAV comprising a R838H mutation within the GUCY2D gene.

FIG. 15B (lanes 3-4) shows Cas9 inactivation in retinas (without RPE) that were transfected with SIN-AAV SpCas9 ver. 2, AAV R838CH_Sp_T1 sgRNA, and an AAV comprising a R838H mutation within the GUCY2D gene.

FIG. 15B (lanes 5-6) show Cas9 expression in retinas (without RPE) that were transfected with Non-SIN-AAV SpCas9, AAV R838CH_Sp_T1 sgRNA, and an AAV comprising a R838H mutation within the GUCY2D gene. FIG. 15B (lane 6) shows a fainter Cas9 band than in lane 5, but the Cas9 band is still present. The retina in lane 6 was not transduced as well as the retina in lane 5. In fact the band for GFP is also fainter in lane 6 compared to lane 5 further demonstrating that the retina in lane 6 was not transduced as well as the retina in lane 5.

FIG. 15B (lanes 7-8) shows no Cas9 expression in retinas (without RPE) that were transfected with AAV R838CH_Sp_T1 sgRNA and an AAV comprising a R838H mutation within the GUCY2D gene.

FIG. 15B (lanes 9-10) shows no Cas9 expression in retinas (without RPE) that were transfected with only AAV R838CH_Sp_T1 sgRNA.

As discussed above, two versions of self-inactivating (SIN) AAV vectors that limit their own expression of Cas9 after transfection were created. Examples of version 1 vectors are depicted in FIGS. 11A and 14A. Examples of version 2 vectors are depicted in FIGS. 11B and 14B. Both version 1 and version 2 vectors comprise two SIN sites (also called R838 target sites), which are vulnerable to cutting by Cas9-sgRNA RNPs. Cas9-mediated double strand breaks at one of these sites could lead to removal of either a promoter or polyadenylation signal in the Cas9 gene. Cas9-mediated double strand breaks at both of these sites occurring contemporaneously could lead to deletion of the Cas9 gene. Both possibilities (e.g., 1 or 2 DSBs) would inhibit Cas9 expression.

It has been observed that version 1 vectors lead to more efficient self-inactivation than version 2 vectors (FIG. 15B). Version 1 vectors comprise a 5' SIN site (R838 target site) that is located upstream of the Cas9 open reading frame (ORF) and downstream of a SV40 nuclear localization signal (NLS). Version 2 vectors comprise a 5' SIN site (R838 target site) that is located upstream of the Cas9 open reading frame (ORF) and upstream of a SV40 nuclear localization signal (NLS) within a 5' untranslated region (UTR). In a version 1 vector, mutations resulting from non-homologous end-joining could create frame-shifts, which cause introduction of premature stop codons in the Cas9 gene ORF. In a version 2 vector, such mutations would be unlikely to create such changes in the Cas9 ORF since the SIN site (R838 target site) is in the 5' UTR, outside of the ORF. These mutations could still disrupt transcription initiation, but their overall effect on Cas9 expression is likely to be less than the mutations in a version 1 vector. Furthermore, once a mutation is created in either vector, a second is unlikely since the site will no longer share sufficient homology with the sgRNA spacer sequence for efficient additional editing. For at least these reasons, there is a disparity in SIN efficiency observed between the two vector versions.

SIN Cas9 vectors showed decreased expression of Cas9 when targeted by either a guide RNA comprising SEQ ID NO: 5285 or 5398, thus providing evidence that SIN vectors of the present disclosure can limit expression of Cas9 protein in vivo.

Example 32—Testing of Guide RNAs in Cells for On-Target Activity

To further evaluate the specificity of gRNAs provided herein, selected gRNAs were further tested for on-target activity in immortalized human patient-derived fibroblasts that have a R838H mutant allele as a copy of the GUCY2D gene.

Patients with a R838H mutant allele provided skin biopsies to create an immortalized cell line. Primary fibroblasts were isolated from these biopsies and cultured in 10% FBS/DMEM supplemented with GlutaMAX™, a supplement comprising an L-alanyl-L-glutamine dipeptide in 0.85% NaCl manufactured by Thermo Fisher Scientific, Massachusetts, US. GlutaMAX™ is. Immortalization of patient-derived fibroblasts was conducted by the Natural and Medical Sciences Institute at the University of Tubingen, Germany. The immortalized patient-derived fibroblasts were cultured in 10% FBS/DMEM supplemented with Gluta-MAX™ and passaged every 3-4 days.

A plasmid, pSpCas9 (BB)-2A-miRFP670 ("pSpCas9") (SEQ ID NO: 5512), was obtained (Addgene: Watertown, Mass.). The pSpCas9 sequence contains a CMV promoter-driven SpCas9 gene, SV40 polyadenylation signal, 2A linker peptide, and miRFP670. The 2A linker peptide is located on the plasmid between the SpCas9 gene and miRFP670 and is cleaved after translation. Therefore, if the SpCas9 gene is transcribed and translated, then RFP is also transcribed and translated.

pSIA012 (SEQ ID NO: 5469), depicted in FIG. 11D, comprises a sequence that encodes for a U6 promoter driven R838H_Sp_T2 sgRNA (a sgRNA comprising SEQ ID NO: 5285) and CMV promoter driven EGFP.

pSIA015 (SEQ ID NO: 5471), depicted in FIG. 11D, comprises a sequence that encodes for a U6 promoter driven R838CH_Sp_T1 sgRNA (a sgRNA comprising SEQ ID NO: 5398) and CMV promoter driven EGFP.

As described in Example 24, pSIA003 is a plasmid that can encode a U6 driven gRNA sequence depending on the gRNA sequence that is cloned into the plasmid. For this particular experiment, the pSIA003 that was used comprises a sequence that encodes for a U6 promoter driven non-targeting (e.g., scrambled) sgRNA that does not target the R838H mutant allele. The non-targeting sgRNA comprises SEQ ID NO: 5513. pSIA003 also comprises a sequence that encodes a CMV promoter driven EGFP.

Immortalized patient-derived fibroblasts comprising a R838H mutant allele were seeded in 2.5 ml of 10% FBS/

DMEM supplemented with GlutaMAX™ at 500,000 cells per well in 6-well plates 24 hours before transfection via electroporation.

The immortalized patient-derived fibroblast cells were transfected with 10 μg of pSpCas9 and 1 μg of either: pSIA012, pSIA015, or pSIA003, using a NEON™ electroporation system (available from Thermo Fisher Scientific, Massachusetts, US).

At 48 hours post-transfection, immortalized patient-derived fibroblast cells were dissociated from the plates by incubation with trypsin-EDTA, and analyzed for red fluorescence (RFP) and green fluorescence (GFP) by flow cytometry. Each of the three plasmids that encodes the sgRNAs used in this Example encodes EGFP, and the EGFP serves as a transfection marker. Immortalized patient-derived fibroblasts transfected with pSIA012, pSIA015, or pSIA003 are GFP positive. RFP and SpCas9 are encoded on the same plasmid and the RFP serves as a transfection marker. Immortalized patient-derived fibroblasts transfected with pSpCas9 are RFP positive.

Immortalized patient-derived fibroblasts that are GFP+ RFP+ are cells that were successfully transfected with one of the three sgRNA plasmids (pSIA012, pSIA015, or pSIA003) and also with pSpCas9. Genomic DNA was extracted from sorted GFP+ RFP+ cells. Indels were analyzed by TIDE to determine editing efficiency in the immortalized patient-derived fibroblasts transfected with pSpCas9 and either pSIA012 (FIG. 16, sample 1), pSIA015 (FIG. 16, sample 2), or pSIA003 (FIG. 16, sample 3).

Figure 16:
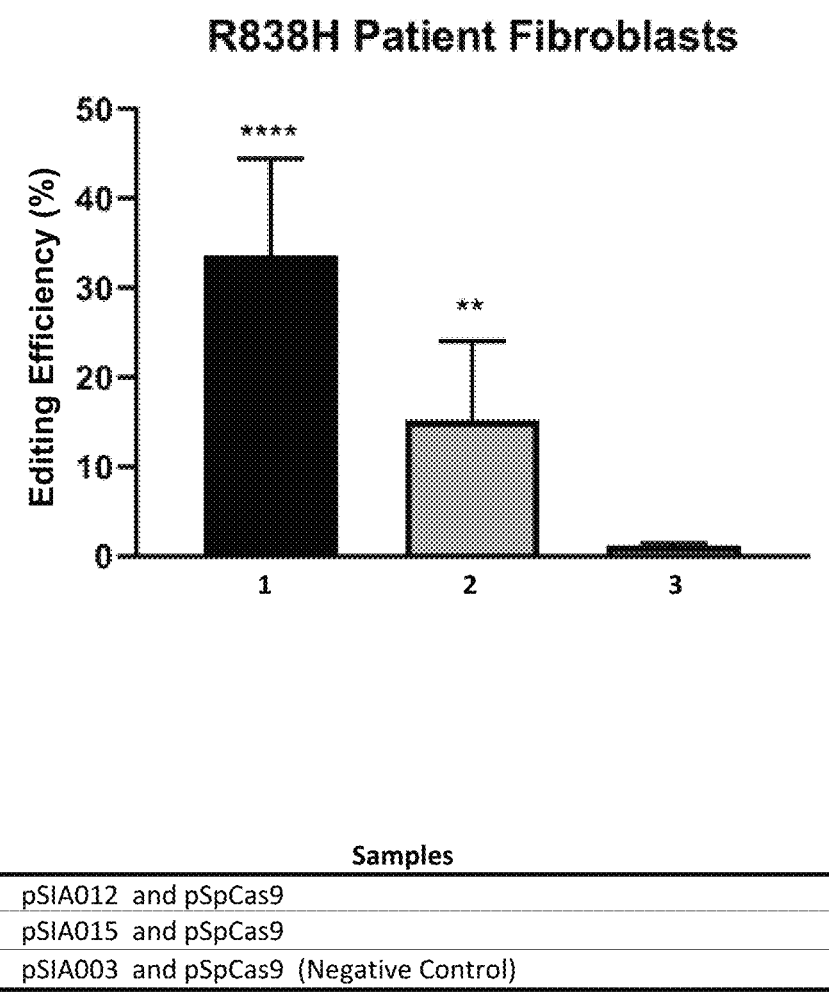
FIG. 16 is a graph showing the editing efficiency for immortalized human patient-derived fibroblasts that have a R838H mutant allele as a copy of the GUCY2D gene, co-transfected with pSpCas9, a plasmid that encodes SpCas9, and either: pSIA012, pSIA015, or pSIA003.

FIG. 16, sample 1 shows that of the GFP+ RFP+ transfected immortalized patient-derived fibroblasts that have the R838H mutant allele, 33.9±10.8% of these cells had the R838H mutant allele edited when R838H_Sp_T2 sgRNA (sgRNA comprising SEQ ID NO: 5285) was used as the sgRNA. The 33.9+10.8% editing efficiency was the result of three separate experiments that included immortalized patient derived fibroblasts from two separate patients. Patient #1's fibroblasts were used in two experiments and Patent #2's fibroblasts were used in one experiment. Two different patients showed consistent ~40% editing in spite of variability that can be seen from one patient to the next. This suggests that a gRNA or sgRNA comprising SEQ ID NO: 5285 consistently edits the R838H mutant allele.

FIG. 16, sample 2 shows that of the GFP+RFP+ transfected immortalized patient-derived fibroblasts that have the R838H mutant allele, 15.5±8.9% of these cells had the R838H mutant allele edited when R838CH_Sp_T1 sgRNA (sgRNA comprising SEQ ID NO: 5398) was used as the sgRNA.

FIG. 16, sample 3 shows that of the GFP+RFP+ transfected immortalized patient-derived fibroblasts that have the R838H mutant allele, 1.15±0.3% of these cells had the R838H mutant allele edited when a non-targeting (e.g., scrambled) sgRNA that does not target the R838H mutant allele was used as the sgRNA. This sample served as a negative control.

These data (presented in FIG. 16) provide evidence that sgRNAs of the present disclosure can effectively edit the mutant R838H GUCY2D gene in human cells.

Example 33—Testing of Guide RNAs in Cells for On-Target Activity

To further evaluate the specificity of gRNAs provided herein, selected gRNAs were further tested for on-target activity in immortalized human patient-derived fibroblasts that have a R838C mutant allele as a copy of the GUCY2D gene.

Patients with a R838C mutant allele provided skin biopsies to create an immortalized cell line. Primary fibroblasts were isolated from these biopsies and cultured in 10% FBS/DMEM supplemented with GlutaMAX™. Immortalization of patient-derived fibroblasts was conducted by the Natural and Medical Sciences Institute at the University of Tubingen, Germany. The immortalized patient-derived fibroblasts were cultured in 10% FBS/DMEM supplemented with GlutaMAX™ and passaged every 3-4 days.

Immortalized patient-derived fibroblasts comprising a R838C mutant allele were seeded in 2.5 ml of 10% FBS/DMEM supplemented with GlutaMAX™ at 500,000 cells per well in 6-well plates 24 hours before transfection via electroporation.

The immortalized patient-derived fibroblast cells were transfected with 10 μg of pSpCas9 and 1 μg of either: pSIA012, pSIA015, or pSIA003, using a NEON™ electroporation system (available from Thermo Fisher Scientific, Massachusetts, US).

At 48 hours post-transfection, immortalized patient-derived fibroblast cells were dissociated from the plates by incubation with trypsin-EDTA, and analyzed for red fluorescence (RFP) and green fluorescence (GFP) by flow cytometry. Each of the three plasmids that encodes the sgRNAs used in this Example encodes EGFP, and the EGFP serves as a transfection marker. Immortalized patient-derived fibroblasts transfected with pSIA012, pSIA015, or pSIA003 are GFP positive. RFP and SpCas9 are encoded on the same plasmid and the RFP serves as a transfection marker. Immortalized patient-derived fibroblasts transfected with pSpCas9 are RFP positive.

Immortalized patient-derived fibroblasts that are GFP+ RFP+ are cells that were successfully transfected with one of the three sgRNA plasmids (pSIA012, pSIA015, or pSIA003) and also with pSpCas9. Genomic DNA was extracted from sorted GFP+ RFP+ cells. Indels were analyzed by TIDE to determine editing efficiency in the immortalized patient-derived fibroblasts transfected with pSpCas9 and either pSIA012 (FIG. 17, sample 1), pSIA015 (FIG. 17, sample 2), or pSIA003 (FIG. 17, sample 3).

Figure 17:
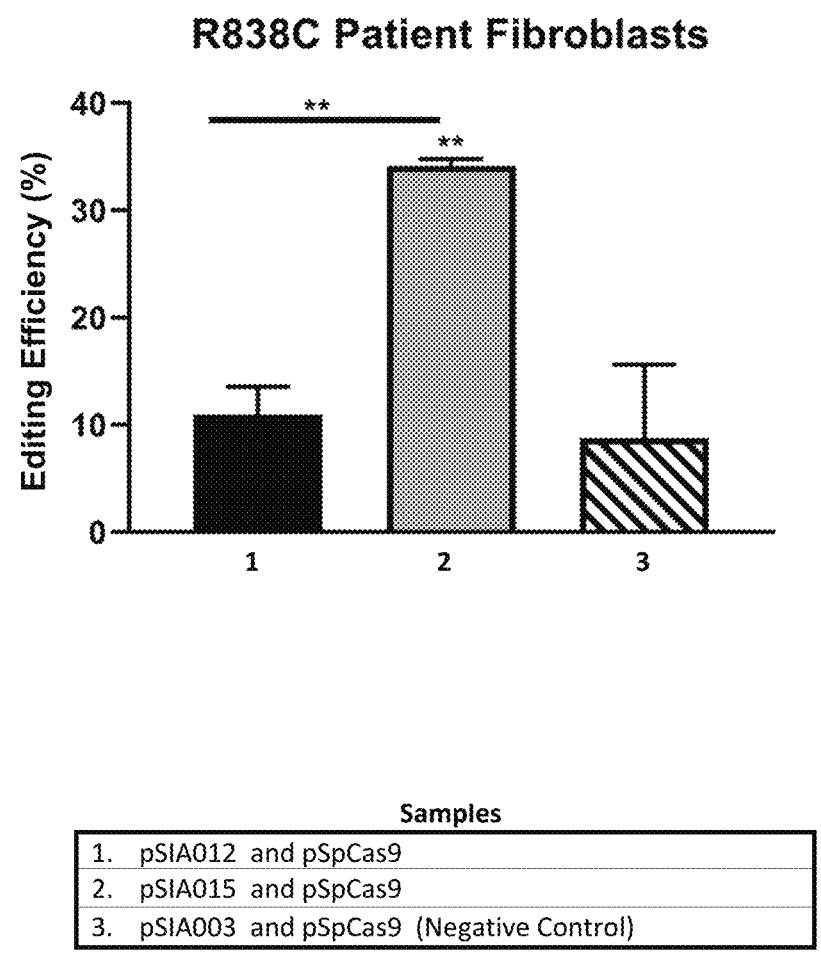
FIG. 17 is a graph showing the editing efficiency for immortalized human patient-derived fibroblasts that have a R838C mutant allele as a copy of the GUCY2D gene, co-transfected with pSpCas9, a plasmid that encodes SpCas9, and either: pSIA012, pSIA015, or pSIA003.

FIG. 17, sample 1 shows that of the GFP+RFP+ transfected immortalized patient-derived fibroblasts that have the R838C mutant allele, 10.98±2.6% of these cells had the R838C mutant allele edited when R838H_Sp_T2 sgRNA (sgRNA comprising SEQ ID NO: 5285) was used as the sgRNA.

FIG. 17, sample 2 shows that of the GFP+RFP+ transfected immortalized patient-derived fibroblasts that have the R838C mutant allele, 34.15±0.6% of these cells had the R838C mutant allele edited when R838CH_Sp_T1 sgRNA (sgRNA comprising SEQ ID NO: 5398) was used as the sgRNA.

FIG. 17, sample 3 shows that of the GFP+RFP+ transfected immortalized patient-derived fibroblasts that have the R838C mutant allele, 8.75±6.9% of these cells had the R838C mutant allele edited when a non-targeting (e.g., scrambled) sgRNA that does not target the R838C mutant allele was used as the sgRNA. This sample served as a negative control.

These data (presented in FIG. 17) provide evidence that sgRNAs of the present disclosure can effectively edit the mutant R838C GUCY2D gene in human cells.

Example 34—Testing of Guide RNAs in Cells for Off-Target Activity

To further evaluate the specificity of gRNAs provided herein, selected gRNAs were further tested for off-target activity in BJ-5TA HDF cells, which are hTERT-immortalized human fibroblast cells that are homozygous for the wild-type copy of the GUCY2D gene ("wild-type fibroblasts").

Wild-type fibroblasts were obtained (as ATCC® CRL-4001TM from ATCC, Manassas, Va.) and were cultured in a 4:1 mixture of supplemented DMEM and Medium 199 and passaged every 3-4 days. DMEM was supplemented with 4 mM L-glutamine, 4.5 g/L glucose, and 1.5 g/L sodium bicarbonate. Medium 199 was supplemented with 0.01 mg/mL hygromycin B and 10% FBS.

pSpCas9, pSIA012, pSIA015, and pSIA003, previously described in Example 32 were used in this experiment. pSIA022 was also used. pSIA022 (SEQ ID NO: 5514), comprises a sequence that encodes for a U6 promoter driven WT_T1_sgRNA (a sgRNA comprising SEQ ID NO: 5274) and CMV promoter driven EGFP.

Wild-type fibroblasts were seeded in 2.5 ml of the 4:1 mixture of supplemented DMEM and Medium 199 at 500,000 cells per well in 6-well plates 24 hours before transfection via electroporation.

Wild-type fibroblasts were transfected with 10 µg of pSpCas9 and 1 µg of either: pSIA012, pSIA015, pSIA022, or pSIA003, using a NEON™ electroporation system (available from Thermo Fisher Scientific, Massachusetts, US).

At 48 hours post-transfection, wild-type fibroblasts were dissociated from the plates by incubation with trypsin-EDTA, and analyzed for red fluorescence (RFP) and green fluorescence (GFP) by flow cytometry. Each of the four plasmids that encodes the sgRNAs used in this Example encodes EGFP, and the EGFP serves as a transfection marker. Wild-type fibroblasts transfected with pSIA012, pSIA015, pSIA022, or pSIA003 are GFP positive. RFP and SpCas9 are encoded on the same plasmid and the RFP serves as a transfection marker. Wild-type fibroblasts transfected with pSpCas9 are RFP positive.

Wild-type fibroblasts that are GFP+RFP+ are cells that were successfully transfected with one of the four sgRNA plasmids (pSIA012, pSIA015, pSIA022, or pSIA003) and also with pSpCas9. Genomic DNA was extracted from sorted GFP+RFP+ cells. Indels were analyzed by TIDE to determine editing efficiency in the wild-type fibroblasts transfected with pSpCas9 and either pSIA012 (FIG. 18, sample 1), pSIA015 (FIG. 18, sample 2), pSIA022 (FIG. 18, sample 3), or pSIA003 (FIG. 18, sample 4).

Figure 18:
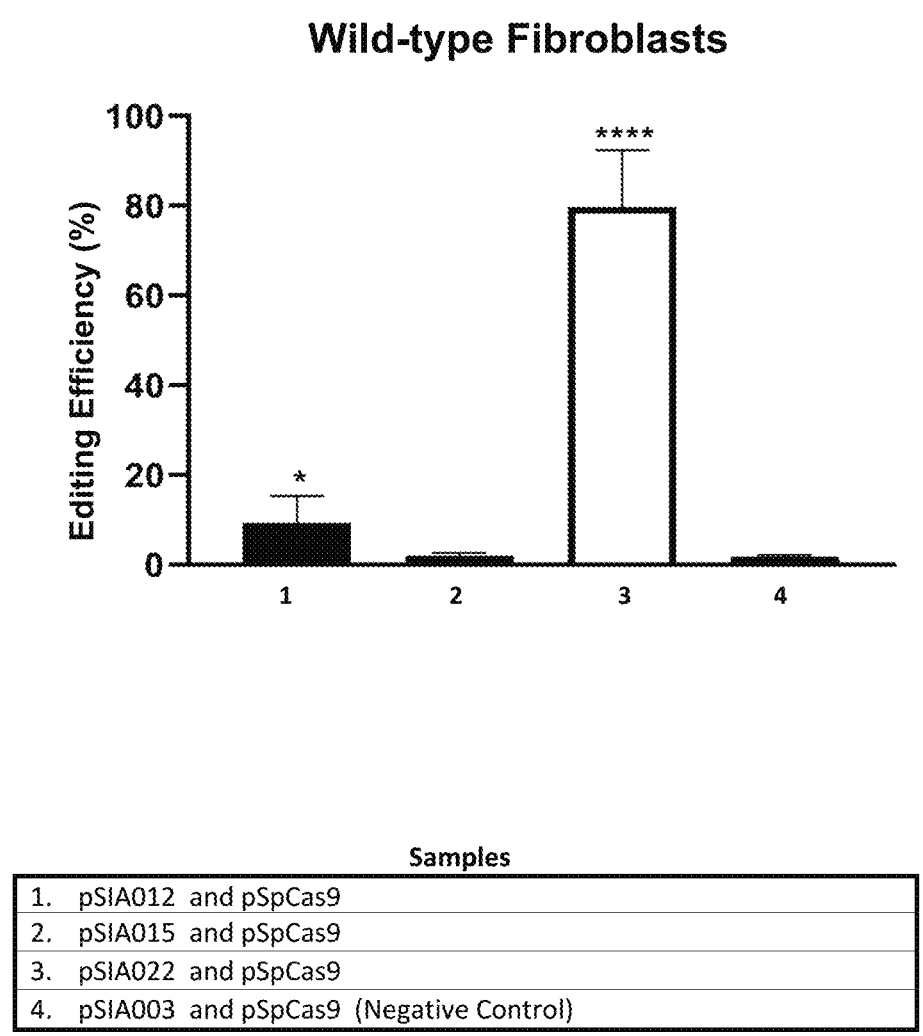
FIG. 18 is a graph showing the editing efficiency for hTERT-immortalized human fibroblast cells that are homozygous for the wild-type copy of the GUCY2D gene, co-transfected with pSpCas9, a plasmid that encodes SpCas9, and either: pSIA012, pSIA015, pSIA022, or pSIA003.

FIG. 18, sample 1 shows that of the GFP+RFP+ transfected wild-type fibroblasts, 9.3±6.0% of these cells had the wild-type GUCY2D allele edited when R838H_Sp_T2 sgRNA (sgRNA comprising SEQ ID NO: 5285) was used as the sgRNA.

FIG. 18, sample 2 shows that of the GFP+RFP+ transfected wild-type fibroblasts, 1.9±0.7% of these cells had the wild-type GUCY2D allele allele edited when R838CH_Sp_T1 sgRNA (sgRNA comprising SEQ ID NO: 5398) was used as the sgRNA.

FIG. 18, sample 3 shows that of the GFP+RFP+ transfected wild-type fibroblasts, 79.7±12.7% of these cells had the wild-type GUCY2D allele allele edited when WT Sp T1 sgRNA (sgRNA comprising SEQ ID NO: 5274) was used as the sgRNA. This sample served as a positive control.

FIG. 18, sample 4 shows that of the GFP+RFP+ transfected wild-type fibroblasts, 1.8±0.3% of these cells had the wild-type GUCY2D allele edited when a non-targeting (e.g., scrambled) sgRNA that does not target the wild-type GUCY2D allele was used as the sgRNA. This sample served as a negative control.

These data provide evidence that sgRNAs of the present disclosure can have minimal off-target activity in human cells.

Note Regarding Illustrative Examples

While the present disclosure provides descriptions of various specific aspects for the purpose of illustrating various examples of the present disclosure and/or its potential applications, it is understood that variations and modifications will occur to those skilled in the art. Accordingly, the invention or inventions described herein should be understood to be at least as broad as they are claimed, and not as more narrowly defined by particular illustrative examples provided herein.

SEQUENCE LISTING (5514 sequences)

SEQ ID NO: 1 - protein, 1368 aa, Streptococcus pyogenes [sequence omitted]

SEQ ID NO: 2 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 3 - DNA, 4107 bp, Streptococcus pyogenes
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagactaa

SEQ ID NO: 4 - DNA, 4140 bp, Streptococcus pyogenes
atggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtga

SEQ ID NO: 5 - DNA, 4200 bp, Streptococcus pyogenes
atggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacgcggccgcagatccaaaaaagaagagaaaggtagatccaaaaaagaagagaaaggtagatccaaaaaagaagagaaaggtagatacggccgcatag

SEQ ID NO: 6 - DNA, 4326 bp, Streptococcus pyogenes
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 7 - DNA, 4359 bp, Streptococcus pyogenes
atgcccaagaagaagaggaaggtgggaagggggatggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 8 - protein, 1409 aa, Streptococcus thermophiles
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 9 - DNA, 4167 bp, Streptococcus thermophiles
atgactaagccatactcaattggacttgatattggaacgaatagtgttggatgggctgtaataactgataattacaaggttccgtctaaaaaaatgaaagtcttaggaaatacgagtaaaaagtatatcaaaaagaacctgttaggtgtattactctttgactctggaatcacagcagaaggaagaagattgaagcgtactgcaagaagacgttatactagacgccgtaatcgtatcctttatttgcaggaaatttttagcacggagatggctacattagatgatgctttctttcaaagacttgacgattcgtttttagttcctgatgataaacgtgatagtaagtatccgatatttggaaacttagtagaagaaaaagtctatcatgatgaatttccaactatctatcatttaaggaaatatttagcagatagtactaaaaaagcagatttgcgtctagtttatcttgcattggctcatatgattaaatatagaggtcacttcttaattgaaggagagtttaattcaaaaaataatgatattcagaagaattttcaagactttttggacacttataatgctatttttgaatcggatttatcacttgagaatagtaaacaacttgaggaaattgttaaagataagattagtaaattagaaaagaaagatcgtattttaaaactcttccctggggagaagaattcggggattttttcagagtttctaaagttgattgtaggaaatcaagctgattttaggaaatgttttaatttagacgaaaaagcctccttacatttttccaaagaaagctatgatgaagatttagagactttgttaggttatattggagatgattacagtgatgtctttctcaaagcaaagaaactttatgatgctattcttttatcgggttttctgactgtaactgataatgagacagaagcacctctctcttctgctatgataaagcgatataatgaacacaaagaagatttagcgttactaaaggaatatataagaaatatttcactaaaaacgtataatgaagtatttaaagatgacaccaaaaatggttatgctggttatattgatggaaaaacaaatcaggaagatttctacgtatatctaaaaaacctattggctgaatttgaaggtgcggattattttcttgaaaaaattgatcgagaagattttttgagaaagcaacgtacatttgacaatggttcgataccatatcagattcatcttcaagaaatgagagcaattcttgataagcaagctaaattttatcctttcttggctaaaaataaagaaagaatcgagaagattttaaccttccgaattccttattatgtaggtccacttgcgagagggaatagtgattttgcctggtcaataagaaaacgaaatgaaaaaattacaccttggaattttgaggacgttattgacaaagaatcttcggcagaggctttcattaatcgaatgactagttttgatttgtatttgccagaagagaaggtacttccaaagcatagtctcttatacgaaacttttaatgtatataatgaattaacaaaagttagatttattgccgaaagtatgagagattatcaatttttagatagtaagcagaagaaagatattgttagactttattttaaagataaaaggaaagttactgataaggatattattgaatatttacatgcaatttatgggtatgatggaattgaattaaaaggcatagagaaacagtttaattctagtttatctacttatcacgatcttttaaatattattaatgataaagagtttttggatgatagttcaaatgaagcgattatcgaagaaattatccatactttgacaatttttgaagatagagagatgataaaacaacgtctttcaaaatttgagaatatattcgataaatccgttttgaaaaagttatctcgtagacattacactggctggggtaagttatctgctaagcttattaatggtattcgagatgaaaaatctggtaatactattcttgattacttaattgatgatggtatttctaaccgtaatttcatgcaacttattcacgatgatgctctttcttttaaaaagaagatacagaaagcacaaattattggtgacgaagataaaggtaatattaaagaggtcgttaagtctttgccaggtagtcctgcgattaaaaaaggtattttacaaagcataaaaattgtagatgaattggtcaaagtaatgggaggaagaaaacccgagtcaattgttgttgagatggctcgtgaaaatcaatataccaatcaaggtaagtctaattcccaacaacgcttgaaacgtttagaaaaatctctcaaagagttaggtagtaagatacttaaggaaaatattcctgcaaaactttctaaaatagacaataacgcacttcaaaatgatcgactttacttatactatcttcaaaatggaaaagatatgtataccggagatgatttagatattgatagattaagtaattatgatattgatcatattattcctcaagcttttttgaaagataattctattgacaataaagtacttgtttcatctgctagtaaccgtggtaaatcagatgattttccaagtttagaggttgtcaaaaaaagaaagacattttggtatcaattattgaaatcaaaattaatttctcaacgaaaatttgataatctgacaaaagctgaacggggaggattgttacctgaggacaaagctggttttattcaacgccagttggttgaaacacgtcaaataacaaaacatgtagctcgtttacttgatgagaaatttaataataaaaaagatgaaaataatagagcggtacgaacagtaaaaattattaccttgaaatctaccttagtttctcaatttcgtaaggattttgaactttataaagttcgtgaaatcaatgattttcatcatgctcatgatgcttacttgaatgccgttatagcaagtgctttacttaagaaataccctaaactagagccagaatttgtgtacggtgattatccaaaatacaatagttttagagaaagaaagtccgctacagaaaaggtatatttctattcaaatatcatgaatatctttaaaaaatctatttctttagctgatggtagagttattgaaagaccacttattgaggtaaatgaggagaccggcgaatccgtttggaataaagaatctgatttagcaactgtaaggagagtactctcttatccgcaagtaaatgttgtgaaaaaagttgaggaacagaatcacggattggatagaggaaaaccaaagggattgtttaatgcaaatctttcctcaaagccaaaaccaaatagtaatgaaaatttagtaggtgctaaagagtatcttgaccccaaaaagtatggggggtatgctggaatttctaattcttttgctgttcttgttaaagggacaattgaaaaaggtgctaagaaaaaaataacaaatgtactagaatttcaaggtatttctattttagataggattaattatagaaaagataaacttaattttttacttgaaaaaggttataaagatattgagttaattattgaactacctaaatatagtttatttgaactttcagatggttcacgtcgtatgttggctagtattttgtcaacgaataataagaggggagagattcacaaaggaaatcagatttttctttcacagaagtttgtgaaattactttatcatgctaagagaataagtaacacaattaatgagaatcatagaaaatatgttgagaaccataaaaaagagtttgaagaattattttactacattcttgagtttaatgagaattatgttggagctaaaaagaatggtaaacttttaaactctgcctttcaatcttggcaaaatcatagtatagatgaactctgtagtagttttataggacctaccggaagtgaaagaaaggggctatttgaattaacctctcgtggaagtgctgctgattttgaatttttaggtgttaaaattccaaggtatagagactataccccatcatccctattaaaagatgccacacttattcatcaatctgttacaggcctctatgaaacacgaatagaccttgccaaactaggagagggttaa

SEQ ID NO: 10 - DNA, 3366 bp, Streptococcus thermophilus
atgagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttctaa

SEQ ID NO: 11 - DNA, 3366 bp, Streptococcus thermophilus
atgagcgacctggtgctgggcctggccatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggctgccatcctgcccctgagcatcaccttcgacgacagcctggccaacaaggtgctggtgtacgccaccgccgctcaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttctaa

SEQ ID NO: 12 - DNA, 3399 bp, Streptococcus thermophilus
atgagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcagcagggctgaccccaagaagaagaggaaggtgtga

SEQ ID NO: 13 - DNA, 3459 bp, Streptococcus thermophilus
atgagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcgcggccgcagatccaaaaaagaagagaaaggtagatccaaaaaagaagagaaaggtagatccaaaaaagaagagaaaggtagatacggccgcatag

SEQ ID NO: 14 - DNA, 3585 bp, Streptococcus thermophilus
atgagcgacctggtgctgggcctggccatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggctgccatcctgcccctgagcatcaccttcgacgacagcctggccaacaaggtgctggtgtacgccaccgccgctcaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 15 - DNA, 3606 bp, Streptococcus thermophilus
atgcccaagaagaagaggaaggtgagcgacctggtgctgggcctggccatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggctgccatcctgcccctgagcatcaccttcgacgacagcctggccaacaaggtgctggtgtacgccaccgccgctcaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 16 - DNA, 3249 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 17 - DNA, 3249 bp, Neisseria meningitidis
atggccgccttcaagcccaaccccatcaactacatcctgggcctggccatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgccgctgccctgcccttcagccgcacctgggacgacagcttcaacaacaaggtgctggtgctgggcagcgaggctcagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 18 - DNA, 3282 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcagcagggctgaccccaagaagaagaggaaggtgtga

SEQ ID NO: 19 - DNA, 3342 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcgcggccgcagatccaaaaaagaagagaaaggtagatccaaaaaagaagagaaaggtagatccaaaaaagaagagaaaggtagatacggccgcatag

SEQ ID NO: 20 - DNA, 3468 bp, Neisseria meningitidis
atggccgccttcaagcccaaccccatcaactacatcctgggcctggccatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgccgctgccctgcccttcagccgcacctgggacgacagcttcaacaacaaggtgctggtgctgggcagcgaggctcagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 21 - DNA, 3489 bp, Neisseria meningitidis
atgcccaagaagaagaggaaggtggccgccttcaagcccaaccccatcaactacatcctgggcctggccatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgccgctgccctgcccttcagccgcacctgggacgacagcttcaacaacaaggtgctggtgctgggcagcgaggctcagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 22 - DNA, 4188 bp, Treponema denticola
atgaagaaggagatcaaggactacttcctgggcctggacgtgggcaccggcagcgtgggctgggccgtgaccgacaccgactacaagctgctgaaggccaaccgcaaggacctgtggggcatgcgctgcttcgagactgctgagaccgccgaggtgcgccggctgcaccgcggtgctcgccggcgcatcgagcgccgcaagaagcgcatcaagctgctgcaggagctgttcagccaggagatcgccaagaccgacgagggcttcttccagcgcatgaaggagagccccttctacgccgaggacaagaccatcctgcaggagaacaccctgttcaacgacaaggacttcgccgacaagacctaccacaaggcctaccccaccatcaaccacctgatcaaggcctggatcgagaacaaggtgaagcccgaccctcgcctgctgtacctggcctgccacaacatcatcaagaagcgcggccacttcctgttcgagggcgacttcgacagcgagaaccagttcgacaccagcatccaggccctgttcgagtacctgcgcgaggacatggaggtggacatcgacgccgacagccagaaggtgaaggagatcctgaaggacagcagcctgaagaacagcgagaagcagagccgcctgaacaagatcctgggcctgaagcccagcgacaagcagaagaaggccatcaccaacctgatcagcggcaacaagatcaacttcgccgacctgtacgacaaccccgacctgaaggacgccgagaagaacagcatcagcttcagcaaggacgacttcgacgccctgagcgacgacctggccagcatcctgggcgacagcttcgagctgctgctgaaggccaaggccgtgtacaactgcagcgtgctgagcaaggtgatcggcgacgagcagtacctgagcttcgccaaggtgaagatctacgagaagcacaagaccgaccttaccaagctgaagaacgtgatcaagaagcacttccccaaggactacaagaaggtgttcggctacaacaagaacgagaagaacaacaacaactacagcggctacgtgggcgtgtgcaagaccaagagcaagaagctgatcatcaacaacagcgtgaaccaggaggacttctacaagttcctgaagaccatcctgagcgccaagagcgagatcaaggaggtgaacgacatcctgaccgagatcgagaccggcaccttcctgcccaagcagatcagcaagagcaacgccgagatcccctaccagctgcgcaagatggagctggagaagatcctgagcaacgccgagaagcacttcagcttcctgaagcagaaggacgagaagggcctgagccacagcgagaagatcatcatgctgctgaccttcaagatcccctactacatcggccccatcaacgacaaccacaagaagttcttccccgaccgctgctgggtggtgaagaaggagaagagccccagcggcaagaccaccccctggaacttcttcgaccacatcgacaaggagaagaccgccgaggccttcatcaccagccgcaccaacttctgcacatacctggtgggcgagagcgtgctgcccaagagcagcctgctgtacagcgagtacaccgtgctgaacgagatcaacaacctgcagatcatcatcgacggcaagaacatctgcgacatcaagctgaagcagaagatctacgaggacctgttcaagaagtacaagaagatcacccagaagcagatcagcaccttcatcaagcacgagggcatctgcaacaagaccgacgaggtgatcatcctgggcatcgacaaggagtgcaccagcagcctgaagagctacatcgagctgaagaacatcttcggcaagcaggtggacgagatcagcaccaagaacatgctggaggagatcatccgctgggccaccatctacgacgagggcgagggcaagaccatcctgaagaccaagatcaaggccgagtacggcaagtactgcagcgacgagcagatcaagaagatcctgaacctgaagttcagcggctggggccgcctgagccgcaagttcctggagaccgtgaccagcgagatgcccggcttcagcgagcccgtgaacatcatcaccgccatgcgcgagacccagaacaacctgatggagctgctgagcagcgagttcaccttcaccgagaacatcaagaagatcaacagcggcttcgaggacgccgagaagcagttcagctacgacggcctggtgaagcccctgttcctgagccccagcgtgaagaagatgctgtggcagaccctgaagctggtgaaggagatcagccacatcacccaggctcctcctaagaagatcttcatcgagatggccaagggcgccgagctggagcctgctcgcaccaagacccgcctgaagatcctgcaggacctgtacaacaactgcaagaacgacgccgacgcattcagcagcgagatcaaggacctgagcggcaagatcgagaacgaggacaacctgcgcctgcgcagcgacaagctgtacctgtactacacccagctgggcaagtgcatgtactgcggcaagcccatcgagatcggccacgtgttcgacaccagcaactacgacatcgaccacatctacccccagagcaagatcaaggacgacagcatcagcaaccgcgtgctggtgtgcagcagctgcaacaagaacaaggaggacaagtaccctctgaagagcgagatccagagcaagcagcgcggcttctggaacttcctgcagcgcaacaacttcatcagcctggagaagctgaaccgcctgacccgcgccacccccatcagcgacgacgagaccgccaagttcatcgcccgccagctggtggagactcgccaagctaccaaggtggccgccaaggtgctggagaagatgttccccgagaccaagatcgtgtacagcaaggccgagaccgtgagcatgttccgcaacaagttcgacatcgtgaagtgccgcgagatcaacgacttccaccacgcccacgacgcctacctgaacatcgtggtgggcaacgtgtacaacaccaagttcaccaacaacccctggaatttcattaaggagaagcgcgacaaccccaagatcgccgacacctacaactactacaaggtgttcgactacgacgtgaagcgcaacaacatcaccgcctgggagaagggcaagaccatcatcaccgtgaaggacatgctgaagcgcaacacccccatctacacccgccaggccgcctgcaagaagggcgagctgttcaaccagaccatcatgaagaagggcctgggccagcaccccctgaagaaggagggccccttcagcaacatcagcaagtacggcggctacaacaaggtgagcgccgcctactacaccctgatcgagtacgaggagaagggcaacaagatccgcagcctggagaccatccccctgtacctggtgaaggacatccagaaggaccaggacgtgctgaagagctacctgaccgacctgctgggcaagaaggagttcaagatcctggtgcccaagatcaagatcaacagcctgctgaagatcaacggcttcccctgccacatcaccggcaagaccaacgacagcttcctgctgcgccccgccgtgcagttctgctgcagcaacaacgaggtgctgtacttcaagaagatcatccgcttcagcgagatccgcagccagcgcgagaagatcggcaagaccatcagcccctacgaggacctgagcttccgcagctacatcaaggagaacctgtggaagaagaccaagaacgacgagatcggcgagaaggagttctacgacctgctgcagaagaagaacctggagatctacgacatgctgctgaccaagcacaaggacaccatctacaagaagcgccccaacagcgccaccatcgacatcctggtgaagggcaaggagaagttcaagagcctgatcatcgagaaccagttcgaggtgatcctggagatcctgaagctgttcagcgccacccgcaacgtgagcgacctgcagcacatcggcggcagcaagtacagcggcgtggccaagatcggcaacaagatcagcagcctggacaactgcatcctgatctaccagagcatcaccggcatcttcgagaagcgcatcgacctgctgaaggtgtaa

SEQ ID NO: 23 - DNA, 4188 bp, Treponema denticola
atgaagaaggagatcaaggactacttcctgggcctggccgtgggcaccggcagcgtgggctgggccgtgaccgacaccgactacaagctgctgaaggccaaccgcaaggacctgtggggcatgcgctgcttcgagactgctgagaccgccgaggtgcgccggctgcaccgcggtgctcgccggcgcatcgagcgccgcaagaagcgcatcaagctgctgcaggagctgttcagccaggagatcgccaagaccgacgagggcttcttccagcgcatgaaggagagccccttctacgccgaggacaagaccatcctgcaggagaacaccctgttcaacgacaaggacttcgccgacaagacctaccacaaggcctaccccaccatcaaccacctgatcaaggcctggatcgagaacaaggtgaagcccgaccctcgcctgctgtacctggcctgccacaacatcatcaagaagcgcggccacttcctgttcgagggcgacttcgacagcgagaaccagttcgacaccagcatccaggccctgttcgagtacctgcgcgaggacatggaggtggacatcgacgccgacagccagaaggtgaaggagatcctgaaggacagcagcctgaagaacagcgagaagcagagccgcctgaacaagatcctgggcctgaagcccagcgacaagcagaagaaggccatcaccaacctgatcagcggcaacaagatcaacttcgccgacctgtacgacaaccccgacctgaaggacgccgagaagaacagcatcagcttcagcaaggacgacttcgacgccctgagcgacgacctggccagcatcctgggcgacagcttcgagctgctgctgaaggccaaggccgtgtacaactgcagcgtgctgagcaaggtgatcggcgacgagcagtacctgagcttcgccaaggtgaagatctacgagaagcacaagaccgaccttaccaagctgaagaacgtgatcaagaagcacttccccaaggactacaagaaggtgttcggctacaacaagaacgagaagaacaacaacaactacagcggctacgtgggcgtgtgcaagaccaagagcaagaagctgatcatcaacaacagcgtgaaccaggaggacttctacaagttcctgaagaccatcctgagcgccaagagcgagatcaaggaggtgaacgacatcctgaccgagatcgagaccggcaccttcctgcccaagcagatcagcaagagcaacgccgagatcccctaccagctgcgcaagatggagctggagaagatcctgagcaacgccgagaagcacttcagcttcctgaagcagaaggacgagaagggcctgagccacagcgagaagatcatcatgctgctgaccttcaagatcccctactacatcggccccatcaacgacaaccacaagaagttcttccccgaccgctgctgggtggtgaagaaggagaagagccccagcggcaagaccaccccctggaacttcttcgaccacatcgacaaggagaagaccgccgaggccttcatcaccagccgcaccaacttctgcacatacctggtgggcgagagcgtgctgcccaagagcagcctgctgtacagcgagtacaccgtgctgaacgagatcaacaacctgcagatcatcatcgacggcaagaacatctgcgacatcaagctgaagcagaagatctacgaggacctgttcaagaagtacaagaagatcacccagaagcagatcagcaccttcatcaagcacgagggcatctgcaacaagaccgacgaggtgatcatcctgggcatcgacaaggagtgcaccagcagcctgaagagctacatcgagctgaagaacatcttcggcaagcaggtggacgagatcagcaccaagaacatgctggaggagatcatccgctgggccaccatctacgacgagggcgagggcaagaccatcctgaagaccaagatcaaggccgagtacggcaagtactgcagcgacgagcagatcaagaagatcctgaacctgaagttcagcggctggggccgcctgagccgcaagttcctggagaccgtgaccagcgagatgcccggcttcagcgagcccgtgaacatcatcaccgccatgcgcgagacccagaacaacctgatggagctgctgagcagcgagttcaccttcaccgagaacatcaagaagatcaacagcggcttcgaggacgccgagaagcagttcagctacgacggcctggtgaagcccctgttcctgagccccagcgtgaagaagatgctgtggcagaccctgaagctggtgaaggagatcagccacatcacccaggctcctcctaagaagatcttcatcgagatggccaagggcgccgagctggagcctgctcgcaccaagacccgcctgaagatcctgcaggacctgtacaacaactgcaagaacgacgccgacgcattcagcagcgagatcaaggacctgagcggcaagatcgagaacgaggacaacctgcgcctgcgcagcgacaagctgtacctgtactacacccagctgggcaagtgcatgtactgcggcaagcccatcgagatcggccacgtgttcgacaccagcaactacgacatcgctgctatctacccccagagcaagatcaaggacgacagcatcagcaaccgcgtgctggtgtgcagcagctgcgccaagaacaaggaggacaagtaccctctgaagagcgagatccagagcaagcagcgcggcttctggaacttcctgcagcgcaacaacttcatcagcctggagaagctgaaccgcctgacccgcgccacccccatcagcgacgacgagaccgccaagttcatcgcccgccagctggtggagactcgccaagctaccaaggtggccgccaaggtgctggagaagatgttccccgagaccaagatcgtgtacagcaaggccgagaccgtgagcatgttccgcaacaagttcgacatcgtgaagtgccgcgagatcaacgacttccaccacgcccacgacgcctacctgaacatcgtggtgggcaacgtgtacaacaccaagttcaccaacaacccctggaatttcattaaggagaagcgcgacaaccccaagatcgccgacacctacaactactacaaggtgttcgactacgacgtgaagcgcaacaacatcaccgcctgggagaagggcaagaccatcatcaccgtgaaggacatgctgaagcgcaacacccccatctacacccgccaggccgcctgcaagaagggcgagctgttcaaccagaccatcatgaagaagggcctgggccagcaccccctgaagaaggagggccccttcagcaacatcagcaagtacggcggctacaacaaggtgagcgccgcctactacaccctgatcgagtacgaggagaagggcaacaagatccgcagcctggagaccatccccctgtacctggtgaaggacatccagaaggaccaggacgtgctgaagagctacctgaccgacctgctgggcaagaaggagttcaagatcctggtgcccaagatcaagatcaacagcctgctgaagatcaacggcttcccctgccacatcaccggcaagaccaacgacagcttcctgctgcgccccgccgtgcagttctgctgcagcaacaacgaggtgctgtacttcaagaagatcatccgcttcagcgagatccgcagccagcgcgagaagatcggcaagaccatcagcccctacgaggacctgagcttccgcagctacatcaaggagaacctgtggaagaagaccaagaacgacgagatcggcgagaaggagttctacgacctgctgcagaagaagaacctggagatctacgacatgctgctgaccaagcacaaggacaccatctacaagaagcgccccaacagcgccaccatcgacatcctggtgaagggcaaggagaagttcaagagcctgatcatcgagaaccagttcgaggtgatcctggagatcctgaagctgttcagcgccacccgcaacgtgagcgacctgcagcacatcggcggcagcaagtacagcggcgtggccaagatcggcaacaagatcagcagcctggacaactgcatcctgatctaccagagcatcaccggcatcttcgagaagcgcatcgacctgctgaaggtgtaa

SEQ ID NO: 24 - protein, 1053 aa, Streptococcus aureas
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 25 - DNA, 3162 bp, Streptococcus aureas
atgaaaaggaattatatcttaggattagatatcggaattacatcagtgggttatggaattattgattatgaaactagagatgtcatagatgcgggcgtacgtttatttaaagaggctaatgttgaaaataatgaaggacgacgatcaaaaagaggtgccagaaggcttaagaggcgtcgtagacatagaatacaaagagtaaagaaacttttatttgattacaatttgttgacagatcatagtgagctaagtggaatcaatccttacgaggcgcgcgtaaagggattaagtcaaaaattaagtgaagaggaattttctgcggcattgctacatttagcaaagcgtagaggtgtacataatgttaatgaagtggaagaagatacaggtaatgaattatccactaaagaacaaatttcaagaaatagtaaagcgttagaagagaagtatgttgcagaattacagttggaacgtttgaaaaaagacggtgaagtgagaggttcgattaaccgtttcaaaacatctgactatgtaaaagaagcaaagcagttattaaaagtacaaaaagcatatcatcaacttgatcaatcatttatagacacttatattgatttattggaaacaagaagaacatattatgagggaccaggtgaaggtagcccatttggatggaaagatattaaagaatggtatgaaatgttaatgggacattgtacgtatttcccagaagaattacgtagtgtgaaatatgcctataatgctgatttatataatgcgctgaatgatttgaacaacttggttattacacgagatgagaatgagaagctagagtattatgaaaaattccaaattatcgagaatgtctttaaacaaaagaaaaagccgacgcttaaacaaattgcgaaggaaatcttggtgaatgaagaagacatcaaaggctatcgtgtcacaagtacaggtaaaccagaatttacaaacttgaaagtttatcacgatatcaaagatattacagcaagaaaagaaattatcgagaatgcagagctactcgatcaaatagctaaaatattaactatttaccagtcatcagaagatatacaagaagaattaacaaacctaaattcagaattgacacaagaagagattgaacaaatttcaaacttgaaaggttatacaggaactcataacctttcactaaaggcaataaatttaatattagacgaattgtggcatacgaacgataatcaaatagctattttcaatcgtttgaaacttgtacctaaaaaggtagatttaagccaacaaaaagaaattcctactactttagttgatgattttatactgtctccagtagtgaaacgttcatttatacaatctattaaagttattaacgctattattaaaaaatacggtttgccaaatgatattattattgaacttgcgagagaaaagaattctaaagatgcacaaaaaatgattaatgaaatgcagaagagaaatcgtcaaacgaatgaacgtattgaggaaattataagaacgacaggtaaagaaaatgctaaatatttaattgaaaaaattaagctgcacgatatgcaagaagggaaatgtttatactcgttagaagcaatccctctagaagatttacttaataatccattcaattacgaagtagaccatatcattccacgttctgtttctttcgataactctttcaataataaagtgttggtgaaacaagaagaaaatagtaaaaaaggtaatagaacgccatttcaatatttaagttcttcagattctaaaataagttatgagacattcaaaaagcatattttaaatcttgctaaaggcaaaggtagaatctctaagacgaaaaaagaatatttgttagaagaacgagatatcaatcgcttcagtgtccaaaaagattttattaaccgtaacttagtagatacacgctatgcgacaagagggttaatgaacttattaagatcttattttagagtgaataacttagatgtcaaagtgaaatcgattaatggcggattcacaagtttcttaagaaggaaatggaagttcaaaaaagaaagaaataagggctacaaacaccatgctgaagatgcactgattattgcgaacgctgattttattttcaaagaatggaaaaaactagataaagctaaaaaagtgatggaaaatcaaatgtttgaagaaaagcaagctgaaagtatgcctgaaattgagactgagcaagagtataaagaaatttttataacgcctcatcaaattaaacatattaaggattttaaagattataaatattcacatagagttgataaaaagccgaatagagagttaataaatgatacattatattctacgagaaaagatgacaagggtaatacattaatcgttaataacttaaatggtttatacgataaagataatgataaattgaaaaaattaattaataaatcacctgaaaaattattgatgtatcatcatgatccacaaacatatcaaaaattaaaattgatcatggaacaatatggcgatgagaaaaatccgctttataaatattatgaagaaacaggcaattacttaacaaaatatagtaaaaaagataacggaccagtcatcaaaaaaattaaatattatggtaacaagctaaatgcgcatttagatattacggatgattatccaaatagcagaaataaagtagtaaaactttcattaaaaccatatcgctttgatgtttatttagataatggggtatataaatttgtgacagttaaaaatttagatgttatcaaaaaagaaaactactatgaagttaattcaaagtgttatgaagaagcaaaaaaactgaagaaaattagtaatcaagcagaatttatcgcaagtttttacaataatgacttgattaagattaacggagaattatatagagtcataggtgtaaataatgatctacttaacagaattgaagtaaatatgatagacatcacatatagagaatatttagagaacatgaatgataaaagaccacctagaataattaaaacaatagcaagcaaaacacaatctattaaaaagtattctacagatattctaggcaatctttatgaagtgaagagtaaaaagcatcctcaaatcataaagaaaggatga

SEQ ID NO: 26 - protein, 1629 aa, Francisella tularensis
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 27 - DNA, 4890 bp, Francisella tularensis
atgaatttcaaaatattgccaatagcaatagatttaggtgttaaaaatactggtgtctttagcgcattttatcaaaaaggaacttctcttgagagattggataataaaaatggcaaagtatatgaactatcaaaagattcttatactttattgatgaataatagaacagcaagaagacatcaaagaagagggatagatagaaagcagctagtcaaaaggctctttaagcttatttggacagagcagctaaatttagagtgggataaagacactcaacaagcaattagctttttatttaatcgtagaggttttagttttattactgatggttattcgcctgaatatttaaatattgttccagagcaagtaaaagcgatacttatggatatatttgatgattacaacggtgaagatgatttagacagttatttaaaattagctactgagcaagaaagcaaaatttctgaaatttataacaagctaatgcaaaaaatattagagtttaaattaatgaaattatgtactgatattaaggatgataaagtaagtactaaaacgcttaaagaaatcacaagctatgaatttgagttattagctgattatttagcaaactatagcgagagtttaaaaacacaaaaatttagttatacagataaacaaggtaatttaaaagagctaagctactatcatcatgataaatataatattcaagaatttctaaagcgacatgctactataaatgatcgaattttagatactcttttaactgatgatttagatatttggaattttaattttgagaaatttgattttgataagaatgaagaaaagcttcagaatcaggaagataaagatcatatacaagcgcatttacatcattttgtttttgcagtaaataaaataaaaagtgaaatggcaagtggtggtcgtcatcgtagccaatattttcaagagataacaaatgtgctagatgaaaataatcatcaagagggatatctcaagaatttctgtgaaaatttgcataataaaaaatattcaaatttaagtgttaaaaatttagttaatctaattggtaacctaagtaatttagagctaaaaccgctaagaaaatattttaatgacaaaattcacgcaaaagctgatcattgggatgagcaaaagtttacagaaacttattgccactggatattaggagagtggcgagtaggtgtcaaagatcaagataagaaagatggcgctaaatatagttataaagatctgtgtaatgaattaaaacaaaaagttactaaggctggtttggtagattttttattagagttagatccatgtagaactataccaccatatctggataacaataaccgtaaaccaccaaaatgtcaaagtttgattttaaatccgaagtttttagataatcaatatccaaactggcaacaatatttacaagaattaaagaaactacaaagtattcaaaattatttagacagttttgaaactgatttaaaagtcttaaagtcaagtaaagatcaaccatattttgttgaatacaagagttcaaatcagcaaatagcaagtggtcaaagagattataaagatttagatgctcgaatattacagtttatatttgatagggtaaaagctagtgatgagttgcttttgaatgagatttattttcaggctaaaaaacttaaacaaaaagctagctctgagttagaaaaactcgagtcgagcaaaaagctagatgaagttatagcaaatagtcaactatcacagatactaaagtctcaacatacaaatggtatttttgaacagggtacttttttgcatttggtttgtaaatattataaacaaagacaaagagcgagagactctaggctatatattatgcctgaatatcgttatgataaaaaactacataaatataacaatacaggcaggtttgatgatgataatcagctgctaacatattgtaatcataagccaagacaaaaaagataccaattgttaaatgatttagctggggtgttgcaggtatcacctaattttttgaaagataaaattggttctgatgatgatctatttattagcaaatggttggtagagcatattagaggatttaaaaaagcttgtgaagatagtttaaaaatacaaaaagacaatagaggattattaaatcataaaataaatatagctaggaatacaaaaggcaaatgtgaaaaagaaatatttaatttaatatgtaaaatagaaggttcagaagataaaaaaggtaattacaagcatggtttagcttacgaattaggagtacttttatttggtgaacctaatgaagctagtaaacctgagttcgatagaaaaattaaaaaatttaactcaatatacagttttgcacagattcaacaaattgcttttgcagagcgtaaaggcaatgctaacacttgtgcagtttgtagtgctgataatgctcatagaatgcaacaaattaagatcactgagcctgtagaggacaataaagataagataatcttaagtgccaaagctcagagactaccagcgattccaactagaatagttgacggtgcggttaagaaaatggcaactatattagctaaaaatatagttgatgataattggcagaatatcaaacaagttttatcagcaaaacatcagttacatatacctattatcacagaatcaaatgcttttgagtttgaaccagcattagctgatgtaaaaggtaagagcctaaaagataggagaaaaaaagcattagagagaataagtcctgaaaatatattcaaggataaaaacaatagaataaaagaatttgctaaaggtatatcagcatatagtggtgctaatttaactgatggcgattttgatggtgcaaaagaagaattagatcatataatacctcgttcacataaaaaatacggtactctaaatgatgaagcaaatctaatttgtgtaactcgtggtgataataaaaataaaggtaatagaattttctgcctacgtgatcttgcagataactataaactaaaacagtttgagacaactgatgatttagaaattgaaaagaagatagctgatacaatctgggatgctaacaagaaagattttaaatttggtaattatcgtagttttattaacctaacaccacaagagcagaaagcatttcgtcacgcgctatttctggctgatgaaaatcctatcaaacaagcagtcataagagcgataaataatcgtaatcgtacatttgtaaatggcactcaacgctattttgcagaagtactggcaaacaatatctatctaagggctaaaaaagaaaatctaaatacagataaaatttcatttgattattttggtattccaactataggtaatggtagaggtattgctgaaatccgtcaactttatgaaaaagttgatagtgatatacaagcttatgcaaaaggtgataaacctcaagctagctactctcacctaatagatgcgatgctggctttttgtattgctgctgatgaacacagaaatgatggaagtataggtctagaaatcgataaaaattatagtttatatccattagataaaaatacaggagaagtctttaccaaagatatttttagtcaaattaaaattactgataatgagtttagcgataaaaaattagtaagaaaaaaagctatagagggctttaacacgcatagacaaatgactagagatggcatttatgcagaaaattacctaccaatactaatccataaagaactaaatgaagttagaaaaggctatacttggaaaaatagtgaagaaataaaaatattcaaaggtaaaaagtacgatatacaacaattgaataaccttgtgtattgtctaaaatttgtagataaacctatatctatagatatacaaattagtaccttagaagagttaagaaatatattaacaacaaataatatagctgctacagcagaatactattatataaatctaaaaacccaaaaattacatgagtattatatcgaaaactataatactgccttaggttataaaaaatacagtaaagaaatggagtttttgagaagcttagcttatcgtagcgaaagggtaaaaattaaatcaatagatgatgtaaagcaggttttggataaggatagtaactttatcatcggtaagattactttaccatttaaaaaagagtggcaaagactatatcgtgagtggcaaaatacaactatcaaagatgattatgagtttttaaaatcattctttaatgttaaaagtattactaagttgcataaaaaagttagaaaagatttctctttacctatttctacaaatgaaggtaaattcctggtcaaaagaaaaacatgggataacaattttatctatcagatattaaatgattctgattctagagcagacggaacaaagccatttattccagcttttgacatttctaaaaatgaaatagtcgaagccataattgattcatttacatcaaaaaatattttttggctgcctaaaaatatagaattacaaaaggtggataataaaaacatttttgctatagatactagtaaatggttcgaagtagaaacacctagtgatcttagagacattggaatagcaacaattcaatacaagatagataataattctcgccctaaagtcagagttaaacttgattatgttatcgatgatgatagtaagataaattattttatgaatcattctttattaaaatcaagatatcctgacaaagttttagaaattttaaaacaatcaactattatagaatttgaaagttcaggttttaataaaactatcaaagaaatgcttggtatgaaattagcaggtatttataatgaaacatctaataattag

SEQ ID NO: 28 - protein, 1300 aa, Francisella tularensis subsp. novicida (strain U112)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 29 - protein, 1307 aa, Acidaminococcus sp. (strain BV3L6)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 30 - protein, 1064 aa, Bradyrhizobium sp. BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 31 - protein, 1035 aa, Candidatus Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 32 - protein, 1358 aa, Acidaminococcus
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 33 - protein, 1358 aa, Acidaminococcus sp. D21; identical to SEQ ID NO: 32

SEQ ID NO: 34 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 35 - protein, 1045 aa, Acidovorax avenae
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 36 - protein, 1131 aa, Acidovorax ebreus
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 37 - protein, 1056 aa, Actinobacillus minor NM305
MKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 38 - protein, 1054 aa, Actinobacillus pleuropneumoniae serovar 10 str. D13039
MKLTPLNYILGLDLGIASVGWAVVEIDEQENPLGLIDVGVRTFDRAEVAKTGESLALARRLARSSRRLVKRRADRIKKVKRLLKSENILLSADEQLPNDVWQLRVKGLDQKLERQEWAAVLLHLLKHRGYLSQRKNESKSENKELGALRSGVAANHQILQSAEYRTPAEIAVKKFHVEEGHIRNQRGAYTHTFSRLDLLAEIELLFTRQTELGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKHRESAVQKFKEYFPNFVGEPKGKDILKMRLYELQQAKCLYSGKSLELHRLLEKGYVEVDHALPFSRTWDDSFNNKVLVLANENQNKGNLTPYEWLDGKNNSEPWQNFVARVQTSGFSHTKKQRILSHKLDEKGFIERNLNDTRYVVRFLCNFIADNMLLTGKGKRKVFASNGQITALLRGRWGLQKVRDDNDRHHALDAVVVACSTVAMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLNDLERMVNREREMALYESLKVRLEQFDNDPAKAFAEPFYKKGGALVKAVRVEQTQKSGVLVRDGNGVADNASMVRVDVFTKAGKYFLVPIYTWQVAKGILPNKAVTANVDEIDWLEMDESYQFIFTMYPNDLVKVKLKKEEFFGYYGGLDRATGAIVIKEHDLEKSKGRQGIYRIGVKLALSFEKYQVDELGKNIRPCRPTKRQHVR

SEQ ID NO: 39 - protein, 1062 aa, Actinobacillus succinogenes
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 40 - protein, 1054 aa, Actinobacillus suis
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 41 - protein, 1105 aa, Actinomyces coleocanis DSM 15436
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 42 - protein, 1113 aa, Actinomyces georgiae F0490
MSASSQNVERIRYKVGIDVGLRSIGFCAVQVDADDRPVKLLNTVVHVHDAGVSPADAKKADTRKLVSGVARRTRRLYRTRKRRLVDLDRQLDGLGWPLVDPARFADPREPWFAREKLVSGRVDDADERKELLSVALRHIAHHRGWRNPYSTVESLQADAPPSEFLQGLNQRVSEKLGTELDPGLTQGQLVAKLLHRFPNAKIRGPEGILRGKLHQSDNAGELRLICRTQGLDCHITEELVRLVFQAKSPKANKEMRKRIGRDQLPGQGAHIRAEKAHPVFQRFRIVAVLANLRIREAHVDRRLTAEEMRTLTDFLLGLAGSEQPTWEELADNLNIERHQLRGTAKASVDGAPALRFPPIDATTDRIYASKLKWLAEWWRQADEERRGYMVDALSNSGGSEDEPYLDDEIAEMLEQASEEDQAKLDSLHLPGGRASYCLDTLRRLTDAMLGGGLDLFEARKAVFHVDDDWAPPTDPIGAPVGNPPVDRVLKHVARWLEAATGRWGAPQTINIEHVREGLGSEKAARELTRMNDRRRRNNQKLVEEMGEKLGMSGRIRRSDRMRYEAIRRQNCECLYCGQPITYQTMEMDHIVPRAGAASTNSRSNLAAVCRRCNHQKGKLPFAVWAESQDSPAEVRLQDAVQRVRHWLRDAGMGQKELQALRVQVIARLKSKRPDEEFDGRSMESIAWMANELRARVEAQYRGSGTTVRVYRGALTAEARKASGFEGRVNLIGGRGKDRFDRRHHAMDALVIALMNQSVAQTLALRLNMRDSQWLTQSEQTWRQFHGAPGEAARKWEAWDRDMRDASDLFNLALDGGRIPITENVRLRVGNGRVHEDGVIRFKPEYEVKGKTIKGGEARLLGDSLPSEQIDRAETPALWTALTRLPEYDRKSGLPENPDRVIRVNGAVVQATDRIRFFGTPASVAVRGGYAKLGESIHHARIYRINGKTPKYAMIRVYTIDLMRLNHEDIFTAVLKPSTISMRCAEKKLKYAIAEGNAEQIGWLVEGDQLELDAAAYAKGVGADLMREYPMATCWRVAGFPDEAKLRLRPVLLAAEGMGEDAPKFMREVLENQGWRPAVNALLSPGSVRVVRRNVLGEPRFKSSGHLPTTVDLV

SEQ ID NO: 43 - protein, 1101 aa, Actinomyces naeslundii str. Howell 279
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 44 - protein, 1144 aa, Actinomyces sp. ICM47
MSMIDSSENVPGIRYRVGIDVGLKSIGFCAVEVDRNDQPVRMLNSMVFIHDAGVDPNENKAAKSRKLTAGVARRTRRLYRTRHQRLVNLDRVLSKEFGWPLPDLTSFKDPREPWHVRAGLLEGYIADDEKRKEALSIALRHIARHRGWRNPYAKVETLLQPSEPSDFLKGLNDRISEELGRAFPADATPGQLVDTYLAHPDYVGRAGTPKLRGPQGILAGKLHQSDNAQEIRGICDVQRIEPAERDRLIRVVFEAKSPKGSAKERGLVGYDELPGQGRHVRAEKAHPAFQLFRMVSVLANLRIREGREERPLTPDELEDLVDFINQVSLKQEVTWQDLADKLRIERADLRGTAKASFDGSPVLRNPPTDVTTEKIMACKVKWLKEWWKEADDEQRGYMVDAFSNSGGSEDGTDVNDEVAELLEQATEDDQLEFEKISLPQGRAAYSLDSLRRLTDRMLRDGVDLHTARRLEFNVGDDWKPAVEPIGAPTGNPAVDRVLKQVSRWLHAATERWGEPTVINIEHARDGLGSERVARELMRENEKRRKANASAVAEMAAKLKLSGKVHRSDQIRYFALQRQNCQCLYCGAPITYTTAEMDHIVPRADGSSTNDRSNLAAVCRTCNHMKGKIPFAVWASSDKANQGVSLTGALERVNMWQRDSGMSPRQLKQLQREVCARLKSKKPDQEFDGRSMESVAWMAVELRTRIEGFYRSRDEESVPSVGVYRGQLTAEARRASGFESRVNLIGGRGKTRFDRRHHAMDALVIALMNPSVSRTLALRLNMRDAQRLTGVEETWKHFYGKPGEASKRFESWRESMLRGVELFNIALSDNAIPFVENIRLRVGSSVIHDATVHSFCPPKTPDGKQIITKGYGEQHSLGSAMPVELIDRAETPALWTALTRCPDFDPKKGLPENPQRTISVNGTRVGPTELVNFFEFSKSGPKACLKVRGGYVDLSGAIHHARIYRIAGKKTAYAMIRVFQVDLLRLKDHDVFTTPLKPSTISMRTAEPKIREALANGTATQIGWLVEGDELVIDTSKYSGGFIGEVLARYPEATSWRVAGFMTPAKLRIKPILLSKEGFVDETQAALLGVEVTSEAIQKTVDRPGWLPAVNVLFGAGGVRVIRRNCLGEERYHSSASLPVSMTLE

SEQ ID NO: 45 - protein, 1095 aa, Actinomyces sp. oral taxon 175 str. F0384
MPAHHLRVGIDVGTHSVGLATLRVDDQGTPIELLSALSHIHDSGIGKEGQKDHDTRKKLSGVARRTRHLLRNRRERLQQLDKVLVDLGFPIPKPEEYPDLSERTDPYRVWRVRARLVEETLPEELRGPAISMAVRHIARHRGWRNPYSKVESLLSPAEESSFMKALRKRIMTKTGEVLDDDITPGQAMAQVALTHKIYMRGPEGILGKLHQSDNANEIRKICARQGISSDVCKQLLRAVFKAESPRGSAVSRVAPDPLPGQGSFRRAPKCDPEFQRFRIISIVANLRISETKGENRPLTVDERRQVVAFLMEDSQADLTWVDVAEKLRVSRQALRGTAMLTADGERSAAQPPIDVTDQIMRKTKISALKTWWDKADAERRGAMVRYLYEGLEDSECAEVIAKLPEKDHAKLDSLHLPAGRAAYSRESLTALSDHMLETTNDLHEARKRLFGVDDSWAPPAEPVGAPVGNPSVDRTLKIVARYLSAVESIWGTPEVIHVEHVRDGFTSERTAEERDKANRSRHNDNQKAIEKIQHDYGKEGYISRGDIVRFHALKLQGSACLYCGTTIGYHTCQLDHIVPQAGPGSNNRRGNLVAVCERCNHSKSNTPFAVWAQKCGIPHVGVKEAISRVNGWVEHNHSTSSGDLTRLKKEVIARLRRTQKDPEIDERSMESVAWMANELHHRIAAAYPETTVMVYRGSITAAARKAASIESRINLIGEKGRKDRLDRRHHAVDASVVALMEPSVAKTLAERSSLRGEQRLTGQEQTWKQYTGLTVGARERFEAWRGHMHRLTELFNESLAADEVYVTQNIRLRLSDGSAHTVKASKLVSHRLGDGLTVQQIDRACTPALWCALTREIDFDEKNGLPAREDRVIRVHGQEISSADCIQVFSKRKKTKSDRDEAPFGAIAVRGGFVEIGSSIHHARIYRIEGEKPAYAMLRVFTHDLLSQRHGDLFSAVIPPQSISMRCAATELRQAISEGRATYLGWIVSGDELHIPVETFTTHKIGSFLKDYPNTTRWRICGYDSETMLILKPRILSAEGLNNSSDIAEYVIKNKGWRVAINKLAKVHPTVVRRDALGRPRHSSRSNLPVTWSIE

SEQ ID NO: 46 - protein, 1181 aa, Actinomyces sp. oral taxon 180 str. F0310
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 47 - protein, 1103 aa, Actinomyces sp. oral taxon 181 str. F0379
MTKINDDLRYRVGIDVGLKSIGFCAVEVDENDQPLRLLNSMVFVHDAGVDPNENKAAKSRKLTAGVARRTQRGTAQNRRRLAELDRALSEELNWPLPNLEDFEDSYEPWHTRAELVEHYIKDDAERAEALAIAIRHIARHRGWRNPYLSVDSLLTPQEPSKFLRGLNERVTQALGREFPADATPGQLICAYIDSPKYAETQGIRGDSGILSGKLHQFDNVGEIRKICEVQRLDHDVFKLLVRKVFFAKSPRGSAAGLVGHDQIPGQGKYIRAEKAHPDFQLFRIVAVLTNLRIREGKAERCLTPDELRGLVDYILEVQLKQQVTWADLADNLGIERTDLRGTARASFDGSPALRFPPTDVTAEKIMASKVKWLKDWWDKADSERRGFMVDALSNSGGSTGDNDIDDEVAALLEAATEDEQAELEKIQLPQGRAAYSLDSLRRLTKRMLEEGVDLHTARKEEFNVDDDWRPEPEPIEAPVGNPAVDRVLKQVARWLNMATDRWGVPDVINIEHTRDGLGSEKVARELLRESQKRQDLNQKDMDKMIRELGISGKARRSSLIKYQAIQRQNSMCLYCGTEIGFETAEMDHIVPRALSGSTNDRSNLAAVCRACNHQKGAVPFAVWATSGEAHAGVSLEDAIKRVRLWQKGPGMSPKQHKAFQNEVISRLKSRKPDEEFDGRSMESVAWMAVELRTRIDGYYRKVNSDSVPKVGIYRGQLTAEARKASGFENRVNLIGGKGKTRFDRRHHAMDALVIAMMNQSVSQTLALRVNMRESQRITGQEETWKNFYGKPGQASERFEKWREGMLRAVELFNIELAKNAIPFHENVRLRVGSSKVHDDTVRKFIHAKLGEALSVAMIDCAETPALWTALTRLPDFDPKDGLPEDLSREIYIHSRKITADEQLNFFNSPSACLKVRGGYVEIGSSIHHARVYRIDGKKTTYSMVRVFATDLVKMTHEDVFTTPLKPSTISMRTADPKIRKALADGTATQIGWLVEGDELQLETDKYSGGLIGEVLAEYPQLTSWRVAGFYGVTQLRLRPYMLAAEGIPSDASESLRKVIEGKGWLPAINALLSSGCVKVVRRNCLGEPRFNAKSSLPVSQLLR

SEQ ID NO: 48 - protein, 1120 aa, Actinomyces sp. oral taxon 848 str. F0332
MNAMKQYNAGIDVGINSVGFAAIEVDSKGLPLNILNNMVVLHDSGVDPGTAKTGATRLANSGTARRTRKLIARRRKRLQKLDRYIEVQGWPLVDFSSLPDPYTPWKIRAKLTQDRLEGEEQGRGLSIALRHMARHRGWRNPYEGVESLHSPKEASKQFKDLKDRVTKVSGVIFDEDATPAEVVCDIGLSPKQRLRSAPSAKYKEGATLADEPVGGKSKEGLLGGKLMQSDNANELRKIGIVQGLSNEKVNEIIDQVFASESPKGQAGKRAKKDELPGQEQYVRALRAHLAFQRFRIVAAVANLRILEAEPKHERLLSQSEKDKVIEFLMSADGDDGVTWSDVAEELGIERECLSGTAKRGADGERPSSFPPTNSTNISIVRSKVKPLIEWWRKASDDEQATLVTALSNADELTDDQPSAETVRQFLSSPDEQSQEKIDKISLPKGRAAYSVNSLERLTRRMLKDSVDLFEARKREFGVDNNWTPTPDSIGEPVGNPAVDRVLKIVNRWLLAVTRKWGPPKVVNIEHVRVGFTSAAQTRKYEEENKTNRERNLAILEELRDKFGTSGKIRREDITRFAALRRQNCQCAYCGEAITFFDCEMDHIVPRKGPGSTNTRNNLVAICERCNKSKSNMPFSLWAQNCDIPGVSVEAVIDRVRTWIKDPELNPKQYNNFKKDVIERLRKTVDDDAIDNRSIESVAWMATELADRIGSHFRTAGANTKVRVYRGWLTSEARKASGFEGKINLIGGRGKTRLDRRHHAMDAATIALMRQSVAQTLVERASIRESDRLRRVVSSSWKDYRGADRDKQFSYGSWLNSMNALAELFNRAIDADGIPVTQNLRLRLGNGEAHDATIRSLEKKRVGASWTIGEIDRASTPQLWLALTRQEDFDQNDGLPANASRELRVKNHWFHAEENVTLFPTKSAAIAVRGGYAEIGNTIHHARLYKLPGKKLTYGMIRVFAIDLLCAWHTDLFSSPLLPESISLRTAETKVRRAVEDGAAMYIGWLVDGDEIVLDPETKAFKSNKIGEYLCEFPGTKRWKVDGFPDKEKLRLRPLQLAGEGLPEDVSAGTEEILGPKGNGWRVAINALFKSSQLVVVRRTALGMVRKLSRRHLPLTTRLRG

SEQ ID NO: 49 - protein, 1114 aa, Actinomyces turicensis ACS-279-V-Col4
MQFHFYMVYVTMKGMNDKDASQQLRYRVGIDVGTHSIGFCAVEVDESGMPIQLLNSMVHKHDSGIDPGGNDTATTRLAEAGVARRTRRLIRRRKKRLQELDAFIEECGWPLVDLATITDARSPWRIRAHLATEHIDDEAEQGKLLSIALRHMARHRGWRSPYARISSLHIQADPSEQLKALAQRVSEKTGISLTADQTPAQLISVYLDVFETGKLRGPEGILGGKLMQSDNANELRRIATVQGLDNDLLKKIIGFVFAAESPKGSAAKRVGKDVLPGAHGLRAEKAHPAFQQFRIVSIVQNLRIKEGTGLRALTSEETEIVVDFLNQAGLTEAPTWEEVADNLEIPRSHLKGTATEGFDGIAPSTRPPFDVTSQKILNGKLKKLSAWWKDADYDHRCAMVNALSNVGSDDEGSLADDDVREFLSDFTDEELEALDKVELPGGRAAYSVDSLEKLTNTMLSEGCDLHSARKIAFGVDDSWTPPAEPIGQPVGNPAVDRVLKQVARWISAATNQWGTPESVNIEHVRDALGSEKASREYQRSLQTRRIRNEKLFAEMRERLDIGGKPRRSELTRYLALQRQNCQCLYCGMPITYTDAEMDHIVPRKGAASTNTRENFAAVCRACNHQKSNLPFAVWAEKTERPGVSVKEAYKRVSDMRIEPGMNGRQMNEFRKAIRLRLTTKHADAEIDGRSLESVAWMANELRHRIEGFYRSAENDVTVRVFRGAVTAEGRRASGFESRVNLIGGKGKTRLDRRHHAMDALTIALMEPGIAQTIALRMNMRESQRVLGEQETWKSFTGGSDTARKRWEHWCEEMLRASELFNVFLAEDRIPICQNKRLRLGSSAVHKAIVQPFEASDKRIVSDAMPVELIDRASTPALWTALTRDPDFDPKEGLPANPSRTIRLHDKRLGPNETVEFFPTAAACLAIRGGYCEIGAGIHHARIFRISGKKTTYAMLRVYQCDLVRFQKENLLTVELPANTISVRTAVPKLREALAHGTAEQIGWLVVGDELKIDLSGFTTGQIETFNETYPQATRWEVTGFPTKTQLRLKPLLIASEGLADDVPDDIVKIVKGPGWWPAIDKLLKIGNVVLYRRDTHGKPRVVSHRSLPLSSKLQ

SEQ ID NO: 50 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 51 - protein, 1113 aa, Alcanivorax pacificus W11-5
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 52 - protein, 1029 aa, Alicycliphilus denitrificans BC
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 53 - protein, 1029 aa, Alicycliphilus; identical to SEQ ID NO: 52

SEQ ID NO: 54 - protein, 1146 aa, Alicyclobacillus hesperidum URH17-3-68
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 55 - protein, 1052 aa, Aminomonas paucivorans DSM 12260
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 56 - protein, 1361 aa, Anaerococcus tetradius ATCC 35098
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 57 - protein, 1552 aa, Anaerophaga sp. HS1
MFSQRNNPYCELLQNVKQLYKEKFGKTNQVDNSIIYGFMKRILGLDLGTNSIGWALVENDENDRKGKIIGMGSRIIPMDMSELDNFNKGASISKTAERTRLRMTRRLRERHLLRRARLHRILNIMGFLPEHYRNSIDFIDKKGCFFEGQEPKIAYKPDKNSEQFCFLFTSSFHEMLEDFRKFQPELIQNRKKVPYDWTIYYLRKKALTQKISKEELAWIILNFNTKRGYYHLRGEDEDNQDNKKIKEFRALKVVNVTEREGANSSGKKWYDMELENGWVYSRQSNLPPNLEGKTIELIVSYTLDNNGNIKKDKNGKEKYSLSMPGEEDWNLVKIKTENDLKTSKKSVGEYIYDHLLKNPDQKIRGKLISTIERKFYKEELSRILKTQMNFYEELKNRELYQKCVEELYPNNKSHQQTLLQKDFIHLIVEDIIFYQRPLKSKRAFVNNCPLEYRVYVDKKSGELIKSGVKCIPKSHPLFQEFRLWQYVRNLRIYERERMVNGRLMVNVDVTNELLPDEEHIVRLFDLLNDRKSFKQDDVLRFVGIKSPKDRKRYSWNYPEDKELPGNETRHLILAWLKKVDGVPEDWLDPEKLKALWHLLYSVTDREEIIKGLHSFAKKYELPDTFVEHFKKIPRLEREYGSFSEKAIKKLLPLMRMGKYWKAEEIPADLLEKAQKIIDAEADDRISDEVREKLLHLKDISQLKGLPLWQASYLVYGRHSETGEVVKWRTSEDLEKYILQFKQHSLRNPVVEQVILEALRVVKDIWEHYGEGKEGFFNEIHVEIGRELKNPADKRKKITSQIQENENTNLRIKALLEELFNDPSVKNVRPYSPAQQEILRIYEDGVLNGQKEIPDDILKISKMARPSKSQLVKYKLWLEQKYRSPYTGEIIPLSQLFTSAYEIEHIIPQARYFDDSFSNKVICEAEVNREKGHQLAFEFITKRGGDEIELNFGKKVTILNVEEYQKFVKDHYGRSLRSLSKMRKLLMEDIPDDFIDRQLNDSRYISKVVRNLLSNIVRAEDENSLVSKHLITCTGGVTTRLKHEWGLNDVWNELITPRFVRLNKMGKEKFGEWINKKGKQVFQIQMPLELQKGFNKKRIDHRHHALDALVVACASRSHVNYLNNDSARANASETRYDLRNKLCYKDKTDSNGNYRWKFYKPWESFTEEAKNRLAGTVVSFKSNRRIMTRSSNRYFKWVDTSEGKKKKLVRQIKGDNQAIRKPLHKDTVLGKVSLRKEKKVSLSKAIDLWESIVDKPLKKRIQSLREQGYDKKLLLKYFKDRNNQFNGQDISRVNIYFFDNNLAARRVTLDASFNSEKRIDGITDSGIKKILYAHLQNEKYHGKKDEKGNEISPYELAFSPEGLEEMNANIKKLNGGKPHCPIYKVRLAETIGEKFKLGEKGNKNKKYVEAAKGTNLFFAVYVDEKGVRSFETIPFSVALERRKQKLAVVPEENENKEKLLFYLSPNDLVYVPDEDEKLIDYRQLSINPTRIYKMVSSSGTQCFFIPHFVASPIVQTMELGPNNKSERAWDGQMIKNVCYKLSVDRLGNVKIEK

SEQ ID NO: 58 - protein, 1515 aa, Anaerophaga thermohalophila DSM 12881
MKRILGLDLGTNSIGWALVESDEEQKSGKIQGIGSRIIPMDQNELDNFNKGNTVSQTAERTRLRMVRRLRERHLLRRERLHRVLKEIGFLPEHYLEQIDFTEKPGGFLPGKEPKIAYKPDNFKDKYDFLFQDSYHEMLSDFQDKNPEFIQKRKKVPQDWTIYYLRKKALTAKITKEELAWIILNFNQKRGYYQLRGEDEDVAKNTKKEEFHALKVVKVKEREDSEGASGKWYDIELENGWVYPRQSNIRPDWEGKILELIVTYNLDKDGNIKTDKEGNEKRSFRMPNKDDWTLRKKRTENEIEKSGKTVGEYIYDNLLDAPDLKIRGKLVSTIERKYYRSELEQILTAQKKYHPELSNSELFNKCISNLYPNNDIHRKALLSKDFVHLIINDIIFYQRPLKSKRSTVSNCPLEYRVYVDKVTGEKKKVPLKCIPKSHPLYQEFRLWQYVKNLRLFEKERFENGRLLTNVDVTEQFLPDEDKYVELFEFLNGRKTFKQDDILKFAGIKSAKDRVKYYWNYPQEKEYPGNETRYLIESRLKKIENVPDEWLNYEKIEELWHLLYSVTDKVEIEKGLQSFAAKYQLPDLFVEVFKGFPRMEREYGAFSKKAIKKLLPLMRMGKYWKLENINPDLIEKVQKIIDGEADDNINDGIRERFSEINEMSDLRGMPLWKASYLVYGRHSEAAEVIRWRTSADLDQYIKDFKQHALRNPIVEQVVLEALRVVKDVWNYFGEGREKFFDEIHVEIGRDLKNPADKRQKIANQIQENENTNLRIKALLVELFNDPEVQNVRPYSPVQQQLLKIYEDGVLNAERDIPDDIQKISRMANPTRNQLIRYKLWLEQKYRSPYTGEIIPLNKLFTSEYEVEHIIPRARYFDDSFSNKIISEAEVNRKKDRMLAFEFIKKLGGSTIDLNYGKKVSVLTVEEYQQFVKDHYGINPHSRLKMQKLLMDEIPESFIERQLNDSRYISKMVRNLLSNIVREENENSPVAKQLITCSGSITNTLKQEWGLNDVWNTIITPRFERLNKMGEQKYGEWVNKEGKPVFQIQMPLELQKGFNKKRIDHRHHALDALIVASATRSHVNYLSNEAAKTNAKDTRFDLRNRLCYKEKRGQNRNFTWRFYKPWNTFTEDAKNALNDIVVSFKSNHRVINKSTNRYFKWENLPGGMKKKRLVRQEKGDNWAIRQSLHKDTVLGKVSLRKVKPVSLSVALDSWNNIVDKALKKKIRSLKDQGYDKKLMLKYFKDRRNEYNGENISRVNVYYFDEEMAARRVDLDTSFNSEKRIEGITDSGIKKIIYAHLKNEKYHGQKDDKGKDISPYELAFSPEGIAEMNANIKQLNGGKPHCPIYKVRLAEPVGEKFQLGETGNKTEKLVEVAKGTNLFFGVYANDEGVRSFATVPFYLAVEREKQGLPAVPQENENGDQLLFWLSPNDLVYVPSEEDAHFANPKQIELDNSRIYKMVSSTGTQCFFIPHFVATPIVQTIELGPNNKSERAWDGQMIKKVCYKLSVDRLGNVEIE

SEQ ID NO: 59 - protein, 1168 aa, Azospirillum lipoferum
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 60 - protein, 1068 aa, Bacillus cereus BAG4X12-1
MRYVLGLDIGIASCGWAVINQEKERIEDLGVRIFDKAENPKDGKSLAAPRRDARSTRRTLRRKKHRMQRIKILLVKQGLLFKTELNHLYESATEFDVWNLRLDALERKLHPKEFARVLIHLAKRRGFKSNRKETTLSENGQILESISENQQIMEQQNYRTVGEMILKDKKFENHKRNKDGTYIGTVTRQQLQDEIQMIFHTQRLYKNDYATEEFESSYLEIWASQRPYASKDQIEKMIGYCTLEPKEKRTPKASWSFQYFVALQTINNLRLISKDKIEELSFEEKKQIMNLALEKPIVKYIDIRKLLSIPNDFQFNSLSYSADTVDTTLENKRCIELKEYHSINKVYKQVYGKNTPNLLPIDYDTIAYGLTIFKDDKDILEYLQNKYVNAKGKPIKNLAKKTYDDTFIQALLNLNFTKMGHLSFKALKNIIPFLEEGLSYDKACEKAGYNFKGTSYTERTKYLPVIPQNTNPVVHRALSQTRKVINAIIKKYGSPNAIHIETARELSKTFQERKEIDSRYQDNSKKNEHAIHKLKELGNINPSGINIVKFKLWSEQDGRCMYSGKYIEPHRLFEEGYTEVDHILPYSRSLDDSYNNKILTLGTENQRKGNKTPYEYMGNTSIWDEFETRVQSNKKINFKKQQKLLLQNFSYAREQEFIERNLNDTRYATIYLTSLIQQHLIFSESSSKKKVRTVSGIITSHLRSRWGFNKDRKEGHIHHALDAVIVAVTSNHMIQRVTKYYKLKELNKNLQAKQLPFPEPWEGFRLELEARISPNTQQYLKGIHFKNYADVNLSDIKPIFVSRMPKRSITGELHQETIRKFLGYNEKGKVLTAIKTKLEDIPFDANGDFPMYGKETDLYTYNAIKERYLSHEKDKRKSFQEPLYKPTKSGEIGPLIKSIKIMDTRTIVNPVNQGKGVVYNSKIARTDVFKKEDKYYLIPIYTIDLLKNILPHKAITAGKGYEDWTTIDSSFTFLFSLFPNDLIQIVPSKNKTIKARTTVSKKEILLPSLTGYFKGVHSGTAGITVETHDGSVIANVGSKQLLLFEKYQVDVLGHYTKIKEEKRMGMAI

SEQ ID NO: 61 - protein, 1078 aa, Bacillus cereus BAG4X2-1
MRYVLGLDIGIASCGWAVINQEKERIEDLGVRIFDKAENPKDGKSLAAPRRDARSTRRTLRRKKHRMQRIKVLLVKHGLLSKTELDHLYESATEVDVWNLRLDALERKLYPKEFARILIHLAKRRGFKSNRKETTLSENGQILESISENQQIMEKQNYRTVGEMILKDKKFENHKRNKNGTYVGTVTRQQLQDEIQMIFHAQRLYKNDYATEEFESSYLEIWASQRPYASKDQIEKMIGYCTLEPKEKRAPKASWSFQYFVALQTINNLRLISKDRIEELSFEEKKQIMNLALEKSIVKYIDIRKLLSVPNEFQFNSLSYSADTVDTAVESRKCIELKEYHSINKVYKQIYGENALNLLPKYYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEQTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKIPYEYMGNTSIWNDFETRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLSEIKSIFVSRMPKHSITGELHQETIRKFIGYNEKGKVLTAIKTKLEDIPFDANGDFPMYGKESDLYTYNAIKERYLSHKKDKRKSFQEPLYKPTKSGGIGPLIKSIKIMDTRTIVNPVNQGKGVVYNSKIARTDVFKKEEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDVLGNYTKIKEEKRIGLTTYNDNKKIAAC

SEQ ID NO: 62 - protein, 1069 aa, Bacillus cereus Rock1-15
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLQVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 63 - protein, 1088 aa, Bacillus smithii 7_3_47FAA
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 64 - protein, 1069 aa, Bacillus thuringiensis
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLRVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 65 - protein, 1509 aa, Bacteroides coprophilus DSM 18228
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 66 - protein, 1504 aa, Bacteroides coprosuis DSM 18011
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 67 - protein, 1504 aa, Bacteroides dorei DSM 17855
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSYYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNKSATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 68 - protein, 1509 aa, Bacteroides eggerthii 1_2_48FAA
MKTILGLDLGTNSVGWAVINSVIKEQAERIWIEMAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKTPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERISVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNKKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 69 - protein, 1526 aa, Bacteroides faecis MAJ27
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNSEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 70 - protein, 1509 aa, Bacteroides fluxus YIT 12057
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 71 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 72 - protein, 1436 aa, Bacteroides
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 73 - protein, 1512 aa, Bacteroides nordii CL02T12C05
MKNILGLDLGTNSIGWAVINSEEDGPIVKKRIELAGSRIIPMDAAVLGNFDSGVTKSQTAERTSFRSIRRLRERQLLRRERLHKVLQILGFLPEHYVNDIDFENHPGKIKRNTEPKLPWRKNSMGQFEFIFQDSFEAMLTDFATHQPVFVSEGKKVPYDWTLYYLRKKALTEGISKEELAWLILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTVGCYIYDALLQNPHQKIKGRLVRTVERKFYKEELRLILEKQLSFHPELQDRDLYRACIDALYVSNEAHKNNISGRDFVYLFIDDIIFYQRPLKTKKSLIDNCPYEENQYMDRETGEVKQAPIKCIAKSHPLFQEFRLWQFISNIRIYQRERVLDDGKLETDVDVTPDFLKTEDDYTTLFEWFNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFKKEYGAYSAKAIKKLLPLMRIGKYWELSNIDDKTKERIDKIITGEWDENIHDRVREKAIKLSDITDFKGLPLWLSCYVVYNRHSEARAIAKWESPEDIDSYLRLFRQHSLRNPIVEQVITETLRTVRDIWKRVGQIDEIHVELGREIKNPADKRAKMTAQIVENENTNLRIKALLAEFINSEYEIENVRPYSSNQQEKLKIYEDTVLNGVKEIPEDINTILKKFRESDLKKRPTKSDFLHYKLWLEQKYCSPYTGRIIPLGKLFTSAYEIEHIIPQAHYFDDSFSNKVICEAEVNGLKDKKLGYEFIKHNPGKMVEIGFGKPPVRIFSVEEYERFVKENYSGIKNKMNKLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACATRNHINYLSNESASKKAKISRTDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDDPNLAFSPDGIDKMNKNLTALNDGKYHQPIYKVRVCEPQGNKFSVGTSGNKTSKYVEAAKGTNLFFAVYQTEDGKRSYETIPLNVVIEREKLGWTPVPENNNNGDKLLFWLSPNDLVYVPTADELNNGMRLDNMDKGRIYKMISCSGPQCFFIPQNVSNAIIPVIELGANNKAEKSWNNEMIKVVCVPIRVDRLGCITQINNQK

SEQ ID NO: 74 - protein, 1436 aa, Bacteroides sp. 2_1_16
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIETVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKIGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 75 - protein, 1517 aa, Bacteroides sp. 20_3
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 76 - protein, 1424 aa, Bacteroides sp. 3_1_19
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYHSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 77 - protein, 1510 aa, Bacteroides sp. D2
MKRILGLDLGTNSIGWALVDSEEQRILGMGSRIIPMDQGVLDTFSGGNPVETQTAARTAYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKGDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNRSKRTKLLLEEIPEKMIERQMNDTRYISKFVLPLLSNLVRAEENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNVKGISGL

SEQ ID NO: 78 - protein, 1436 aa, Bacteroides sp. D2
MKRILGLDLGTNSIGWALVDEAENKDERSSIVKLGVRVNPLTVDELTNFEKGKSITTNADRTLKRGMRRNLQRYKLRRETLMEVLKEHKLITEDTILSENGNRTTFETYRLRAKAATEKISLEEFARVLLMINKKRGYKSCRKAKGAEEGTLIDGMDIARELYNNNLTPGELCLQLLDAGKKYLPDFYRSDLQNELDRIWEKQKEYYPEILTEVLKEELRGKKRDAVWAICAKSFVWEEYYTEWNKEKGKTEQQEREHKLEGIYSKRKRDEAKRENLQWRVNGLKEKLSLEQLVIVLQEMNIQINNSSGYLGAISDRSKELYFNKQTVGQYQMEMLDKNPNASLRNMVFYRQDYLDEFNTLWEKQAEYHKELTGELKKEIRDIVIFYQRRLKSQKGLVGFCEFESRQIEVEIDGKKKIKTVGNRVIPRSSPLFQEFKIWQILNNIEVTVVGKKGKRRKQKDNSPTLFDGLDDTEQLELNGSRYLYQEEKELLAQELFVRDKMTKSDVLKLLFDNPQELDLNFKTIDGNKTGYTLFQAYSKMIEMSGHEPVDFKKTVEKVVEHVKAVFDLLNWNTDILGFNSNEELDNQSYYKLWHLLYSFEGDNTPTGNARLVQKITELYGFEKEYAIILANVTFQDDYGSLSAKAIHKILPHLKEGNRYDVACAYAGYKHSESSLTKEEIANKALKDRLTLLPKNNLRNPVVEKILNQMVNVINAIIDTYGKPDEIRVELARELKKNAKEREELTKFIAETTRKHEEFKILLQSEFGLTNVSRTDILRYKLYKELESCGYKTLYSNTYIPREKLFSKEFDIEHIIPQARLFDDSFSNKTLEARSINLEKGNKTAYDFVKEKFGESGADNSLDHYLNNIEDLFKSGKISKTKYNKLKMAEQDIPDGFINRDLRNTQYIAKKALSMLNEISRRVVATSGTITDKLRQDWQLVDVMKELNWEKYKALGLVEYFEDKDGRQIGRIKDWTKRNDHRHHAMDALTVAFTKDIFIQYFNNKNASLNSNTNEYAIKNKYFQNGRAIAPIPLREFRVEAKKHLENTLISIKAKNKVVTGNINKTKKRGGVNKYLQQTPRGQLHLETIYGSGKQYLTKEEKVNASFDMKKIATVSKSAYRDVLLKRLHENDNDPKKAFTGKNSLDKQPIWLDKEQTRKVPEKVKTVTLETIYTVRKEISPDLKVDKVIDAGVRKILTGRLNEYGNDAKKAFSNLDENPIWLNKEKGISIKRVTISGISNAQSLHVKKDKDGKPILDEDSRNIPVDFVNTGNNHHVAVYRRPVIDKRGQLVIDEAGNPKYELEEVVVSFFEAVTRANLGQPIIDKDYKTSEGWQFLFSMKQNEYFVFPNEKTGFNPKEIDLLDAENYGVISPNLFRVQKFAHKNYVFRHHLETTIKDTSSILKGITWIDFRSSKGLDAIVKVRVNHIGQIVSVGEY

SEQ ID NO: 79 - protein, 1508 aa, Bacteroides uniformis CL03T00C23
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKVKVVRLSVALDTPSMIVNKRVKNKVLELLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 80 - protein, 1504 aa, Bacteroides vulgatus CL09T03C04
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLLKKKTEADIDQTHKTVGVYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEITQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 81 - protein, 1434 aa, Bacteroidetes oral taxon 274 str. F0058
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 82 - protein, 1153 aa, Barnesiella intestinihominis YIT 11860
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 83 - protein, 1352 aa, Belliella baltica
MKKILGLDLGTTSIGWAFIKEPEKDVVGSEIVDMGVRIVPLSSDEENDFAKGNTISINADRTLKRGARRNLQRFKQRRNALLEIFKEKKLISTNFKYAEDGPSSTFSTLNLRAKAAKEKIELQDLVKVLLQINKKRGYKSSRKAKSEEDDGSAIDSMGIAKELYENDLTPGQWVYEALQKGRKNVPDFYRSDLQEEFKKIVNYQSEFFPDIFNASFVEDWMGKASTPTKQYFNKKGVQLAENKGKREERRLQEYKWRAEAVNFKIDLSEIALILSQINSQISNSSGYLGAISDRSKELYFKNLTVGQYLYQQIKKNPHTRLKGQVFYRQDYLDEFERIWSVQSSFYPQLNDALKREVRDITIFFQRRLKSQKHLISNCEFEDHHKVVPKSHPVFQEFRIWQNLNNLLLIKKDNLNEKFDLELESKIALANELAFKRELNVKDALKILGLKPNEWEFNFTKIEGNRTNQAFFDAFAKIIELEDGEPIDLGDLKADDILDQFSEAFLRIGIDTELLQVNSDIEGAEYEKQSYIQFWHLLYSSEDDQKLKLNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPELGRPDEIRVEMARELKANAEQRKNMTSNIASATRDHDKYREILKSEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEISRRVSVTTGTITDKLREDWGLVEIMKELNWEKYDKLGLTYTIEGKHGERLNKIKDWSKRNDHRHHAMDALTVALTKPAYIQYLNNLNAKGLNNKKGTEVFAIEQKYLKRENGKLCFIPPIENIRSEAKKHLSRILVSYKAKNKVVTINKNKTKSKAGLNEQIALTPRGQLHKETVYGKSFHYSTKFEKIGASFNVQKINTVAKKEEREALLKRLAENGNDPKKAFTGKNTLNKMPIYLDLGKNIKLSEKVKTVVLEQNYTIRKNIDPDLKVDKVIDVGIKRILESRLEEFGGNAKLAFSNLEENPIWLNKEKGISIKRVKISGVSNVESLHVKKDHFGEPILDQEGNEIPVDFVSTGNNHHVAIYEDENGNLQEEVVSFFEAVVRQNQGLPIIKKNHTLGWKFLFTLKQNEYFVFPSDDFVPADVDLMDEQNYHLISPNLFRVQKIARKNYVFNNHLETKAVDNDLLKSKKELSKITYHFYQTPEHLRGIIKIRINHLGKIIQIGEY

SEQ ID NO: 84 - protein, 1415 aa, Bergeyella zoohelcum ATCC 43767
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 85 - protein, 1430 aa, Bergeyella zoohelcum CCUG 30536
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVITDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGAKFDLETIKKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKFSKLQYGNSFVREFVFRHHLETTVEDRKELQGITYKQMKNSTFFNDIIKVRINHLGDIVSIGEY

SEQ ID NO: 86 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 87 - protein, 1138 aa, Bifidobacterium dentium
MLCRCHRRYRIGIDVGLMSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 88 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 89 - protein, 1124 aa, Bifidobacterium longum subsp. longum 2-2B
LTGHSGHTFWPTSSSPPIQLEQEKRPLPQRNTSQNGHTFWPITRERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFPVSMLMVRLASIYNSSRSLVEGTLHGNIGLLMDSLTRRS

SEQ ID NO: 90 - protein, 1138 aa, Bifidobacterium
MNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 91 - protein, 1151 aa, Bifidobacterium sp. 12_1_47BFAA
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 92 - protein, 1092 aa, Brevibacillus laterosporus GI-9
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 93 - protein, 1428 aa, Burkholderiales bacterium 1_1_47
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRKGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVHSICNAIENERKTYGPYFSEDYKFVKTALKEGKTEKELSKKFAAVIKVLKMVSEVVPFIGKELRLSDEAQSKFDNPYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGASDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 94 - protein, 1442 aa, Caenispirillum salinarum AK4
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 95 - protein, 984 aa, Campylobacter coli 1098
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 96 - protein, 984 aa, Campylobacter coli 111-3
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 97 - protein, 987 aa, Campylobacter coli 132-6
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 98 - protein, 984 aa, Campylobacter coli 151-9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 99 - protein, 984 aa, Campylobacter coli 1909
MARILAFDIGISSIGWAFSENDELKDCGVRIFTKAENPKTGESLALPRRLARSARKCLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 100 - protein, 965 aa, Campylobacter coli 1957
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKILTFKKLNDLKQGKTPFEAFGEDEKLWAEINERIKEYNGKKRFKIFDKFFKDKKPFDFTEQTLQDTRWLTKLVASYLNEYLLFLPINEDENTALGYGEKGSKQHVVLSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 101 - protein, 984 aa, Campylobacter coli 2692
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLTNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 102 - protein, 984 aa, Campylobacter coli 59-2
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 103 - protein, 965 aa, Campylobacter coli 67-8
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVVLSSGMITQMLRNFWYLGFKNHKNYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANTKGSLVRTDLFVDKENKFHAVSIYKADFSTKKLPNKTPATTSNGETKEGIEMNENYNFCMSLYKNTPVSVKIKGMKEPIICYYHGFNTSGSKITYKKHDNNYHNLSEDEMVVFRKNDKESIVVGKILEIKKYSISPSGELSLIENEKRKWF

SEQ ID NO: 104 - protein, 965 aa, Campylobacter coli 80352
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 105 - protein, 987 aa, Campylobacter coli 80352
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 106 - protein, 984 aa, Campylobacter jejuni
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 107 - protein, 987 aa, Campylobacter jejuni subsp. jejuni 110-21
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDNIKNSDNEEKSEILKAIKQNEEKLVNYQSVGEYLYKEYFQKFKENSKEFINVRNKKESYERCIAQSFLKDELKLIFQKQREFGLSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVVINEDKKDFLPAFNETYYKDEVTNPVVLRAIKEYRKVLNALLKKYGKVHKINIELAREVGKNHSQRAKIEKEQNENYKAKKDAELECEKLGLKINNKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPTKKQKRILDKNYKDKEQKDFKDRNLNDTRYIARLVLNYTKDYLDFLPLSDDENTKLNDIQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 108 - protein, 987 aa, Campylobacter jejuni subsp. jejuni 129-258
MARILAFDIGISSIGWAFSENDELKDCGVRIFTKAENPKTGESLALPRRLARSARKRLARRKARLNHLKHLIANEFKLNYEDYQSFNESLAKAYKGSLISPYELRFRALNELLSKQDFARVILHIAKRRGYDDIKNSDDKEKGAILKVIKQNEEKLANYQSVGEYLYKEYFQKFKENSKEFTNVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 109 - protein, 987 aa, Campylobacter jejuni subsp. jejuni 1336
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVSYQSVGEYLYKEYFQKFKENSKEFINVRNKKESYERCIAQSFLKDELKLIFQKQREFGFSFSKKFEEEVLSVAFYKRALKDFSHLVGNCSFLLMKKERQKNSPLAFMFVALTRIINLLNNLKNTEGILYTKDDLNTLLNEALKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKMVKNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 110 - protein, 984 aa, Campylobacter jejuni subsp. jejuni 140-16
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFIQREDFKK

SEQ ID NO: 111 - protein, 984 aa, Campylobacter jejuni subsp. jejuni 1577
MARILAFDIGISSIGWAFSENDELKDCGVRIFTKVENPKTGESLALPRRLARSARKRLARRKVRLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 112 - protein, 987 aa, Campylobacter jejuni subsp. jejuni 1854
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKSLGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 113 - protein, 984 aa, Campylobacter jejuni subsp. jejuni 1997-10
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLNQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 114 - protein, 987 aa, Campylobacter jejuni subsp. jejuni 2008-1025
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 115 - protein, 984 aa, Campylobacter jejuni subsp. jejuni 2008-872
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 116 - protein, 987 aa, Campylobacter jejuni subsp. jejuni 2008-979
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLVNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSEKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 117 - protein, 965 aa, Campylobacter jejuni subsp. jejuni 2008-988
MKIIGFNLGIANIGWALRENDEIIDCGVRVFDIPENPKNGNSLALERRENKARMKIVKRKKARMLATKTFLKKELNVDLSKLFLIGSTQSIYELRAKALSSLISKEELSAIILHIAKHRGYDDSALKNENGTIIEALNKNKETMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQEINFKGLDYSKNNVENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKSEYLPLFEKTRFAKDISSPVVIRAICEFRKLLNDIIRRYGSVHKIHLELTRDFGISFSDRKKIIKEIEQNEQSRIKALETIKELKLEETSKNIQIVRLFEDQKGICPYSGLKMDLNRLDELVIDYIRPYNRSLDDSYSNKVLTFKKLSDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHDLTPLKIKELKNTYGDLDLAVKLGKIRKYNDKYYANANGSLVRADLFVDKKNKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIAVGKILEIKKYSISPSGELSLIENEERKWF

SEQ ID NO: 118 - protein, 984 aa, Campylobacter jejuni subsp. jejuni 2008-988
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVTLTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 119 - protein, 961 aa, Campylobacter jejuni subsp. jejuni 260.94
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNIGFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKLSDLQDEKMLEIDHIYPYSRSFDDSYMNKVLVFTKQNQEKLNKTPFEAFGNDNVKWQKIEVLAKNLPEKKQKRILDKNYKDKEQKDFKDRNLNDTRYIARLVLNYTKDYLDFLPLSDDENTKLKGSKVHVEAKSGMLTSALRHTWGFSTKDRNNHLHHAIDAAIIAYANNSIVKDFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNLKVFEKYIVSALGEVTKAEFRQREDFKNELR

SEQ ID NO: 120 - protein, 985 aa, Campylobacter jejuni subsp. jejuni 414
MAKILAFDIGISSIGWAFVENDELKDCGVRIFTKAENPKTGESLALPRRLARSARKRLARRKARLNHLKHLIANEFKLNYEDYQSFDESLAKAYKGTLISPYELRFKALNELLSKQDLARVILHIAKRRGYDNIKNSDDKEKGAILKAVKENEEKLANYKSVGEYLYKEYFQKFKENSKEFINVRNKKESYERCIAQSFLKDELKLIFQKQREFGFNFSKKFEEEVLSVAFYKRALKDFSHLVGNCSFFVDEKRAPKNSPLAFEFVALTRIVNLLNNLNKNNSYIKDDLNALLSEVLKNGTLTYKQTKKILGLSDDYEFKGQKGNYFIEFKKYKEFIKALCEHNLNQDDLNEIAKDITLVKDETKLKKALAKYDLNQNQIENLSKIEFKDHLNISFKALKLIVPLMREGKKYDEVCNELNLKTAINEDKKEFLPAFNETYYKDEVNNPVVLRAIKEYRKVLNSLLKKYGKVHKINIELAREVGKNHRERSKIEKEQNENFKAKKDAELECEKLGLKINSKNILKLRLFKEQKEFCVYSGEKIKISDLQDEKMLEIDHIYPYSRSFDDSYMNKVLVFTKQNQEKLNKTPFEAFGKDDVKWQKIETLAKNLPAKKQKRILDKNYKDKEQKDFKDRNLNDTRYIARLVLNYTKDYLEFLPLSDDENIKLNDTQKGSKVHVEAKSGMLTSVLRHTWGFSTKDRNNHLHHAIDAVIIAYANASVVKAFSDFKKEQENYTAELYAKKINELDFKNKRKFFEPFSNFRQKVLEKIDEIFVSKPERKKPSGALHEETFYKEEEFYKEYGGKEGVLKALELGKIRKVNGKIVSNANMFRVDIFKYKKTNKFYAVPIYTMDFALGILPNKAVVGGKDKQGIIKDWLLMDENYEFCFSLYKDSLILLQTKDMQEPELVYFKSFKSSTAGLVVSKHDNKFENLNENQKKLFKSANEKKVVAEGIGIQNLKVFEKYIVSALGEITKAEIKERENFKKK

SEQ ID NO: 121 - protein, 984 aa, Campylobacter jejuni subsp. jejuni 51037
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGTILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 122 - protein, 984 aa, Campylobacter jejuni subsp. jejuni 51494
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGLKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 123 - protein, 987 aa, Campylobacter jejuni subsp. jejuni 53161
MARILAFDIGISSIGWAFSENDELKDCGVRIFTKAENPKTGESLALPRRLARSARKRLARRKARLNHLKHLIANEFKLNYEDYQSFDEGLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 124 - protein, 984 aa, Campylobacter jejuni subsp. jejuni 60004
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 125 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 126 - protein, 984 aa, Campylobacter jejuni subsp. jejuni 84-25
MVRILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 127 - protein, 984 aa, Campylobacter jejuni subsp. jejuni 87459
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTFLNEVLKNGTLTYKQTKKLLGLSDDYEFKGEKGTYFIEFKKYKEFIKALGDHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 128 - protein, 984 aa, Campylobacter jejuni subsp. jejuni ATCC 33560
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHTIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 129 - protein, 987 aa, Campylobacter jejuni subsp. jejuni CF93-6
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRVPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYGVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 130 - protein, 984 aa, Campylobacter jejuni subsp. jejuni CG8486
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 131 - protein, 984 aa, Campylobacter jejuni subsp. jejuni HB93-13
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFLKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 132 - protein, 987 aa, Campylobacter jejuni subsp. jejuni LMG 23210
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALVKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 133 - protein, 984 aa, Campylobacter jejuni subsp. jejuni LMG 23211
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALDEHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNKTPFEAFGNDGVKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLVVSKHDNKFETLSKNQKILFKNANEKEVIAKSIGIQNLKVFEKYIVSALGEVTKAEFRQREDFKK

SEQ ID NO: 134 - protein, 984 aa, Campylobacter jejuni subsp. jejuni LMG 23263
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAEFECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 135 - protein, 984 aa, Campylobacter jejuni subsp. jejuni LMG 23264
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 136 - protein, 987 aa, Campylobacter jejuni subsp. jejuni LMG 23269
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFHQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 137 - protein, 987 aa, Campylobacter jejuni subsp. jejuni LMG 23357
MARILAFDIGISSIGWAFSENDELKDCGVRIFTKAENPKTGESLALPRCLARSARKRLARRKARLNHLKHLIANEFKLNYEDYQSFDESLAKAYKGSLISPYELRFRALNELLSKQDFARVILHIAKRRGYDDIKNNGDEEKGEILKAIKQNEEKLVSYQSVGEYLYKEYFQKFKENSKEFINVRNKKESYERCIAQSFLKDELKLIFQKQRKFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKIVSNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 138 - protein, 984 aa, Campylobacter jejuni subsp. jejuni NCTC 11168 = ATCC 700819
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 139 - protein, 983 aa, Campylobacter jejuni subsp. jejuni NW
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 140 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYPVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 141 - protein, 1003 aa, Campylobacter lari
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 142 - protein, 1430 aa, Capnocytophaga canimorsus
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVDKNQQAVLFEEEKTIFELDLEAKQALFNELNLKGNLKAYYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTVNINKAKTEHEKIIKILKNEFGLPNPTRNDIIRYRLYEELKANGYKDLYTNEYIEKQDLFTKNIDIEHIIPKSRVFDDSFSNKTLSFRKTNLDKGERTAFDYIESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVAISGVANAEPLHTKKDHLGKEILDKEGKSIPVDFISTGNNHHVAVYRDEKGNLQEKVVSVFEAVVRANQGLPIIDKTYNQHLGWEFLFTMKQNEMFVFSNESTGFNPNDIDLLDPKNKKIISPNLFRVQKFSKLQYGNSFVREFVFRHHLETTVEDRKELQGITYKQMKNSAFFNDIIKVRINHLGGIVSVGEY

SEQ ID NO: 143 - protein, 1436 aa, Capnocytophaga gingivalis ATCC 33624
MKYIKYILGLDIGSNSIGWALIQLDLLQKTKRIIAAGSRIIPMDQKVLSDFGKGITISPTAQRTSYRNARHCRERHLLRRERLHRVLHILGFLPTHYDKQIDFSKRYGKFVDNTEPKIAYNEGKFLFMDSFQEMLSDFKSHQPDLFYTKKNGEESKIPYDWTIYYLRKKALSQKISKEELAWIILNFNQKRGYYQLREEEGNKENDFEIISSKIISVIKKDKDKKYNKYWYDIILENGLVYQAAFYNDFVYNWINQDREFIIERTSLKNGAEKVKLSYLPTFDEIDKMDKKEQDKYYKKIKIKTENSIGNKTVGCYIYDHILQNPNEKIKGKLVRTIERKYYKEELKAILEKQIALQPELFTDQLLADCIRELYSKNEAQQRNLAARDFVHLLVEDIIFYQRPLRRQKSTLANCSLESRSYIDKDSHTRKEAPLKVCPKSNPYYQEFRVLQWLQNLKIYEIDSDQEVTHQFIKTLEDKQQLFEFLMAQKEIDCEELLKYFLNQTYPNAKEKALKSELKKWKDTYRWNYVYDIGEKSSKKYPMNETRYELKRHLEKVANLPDDFLSSEVEYLLWHLIYSVKDKVAYEKGLKKFAQKHHLDKDSFVESFKKFNPYPSEYGSFSEKAIRKLLPLMRFGAHWDFNHIDKNTQKRIEDLITGVENEEIRTILREKAEKYQLEKETDFQDLPLWLAQYIVYNRHAEASSLEKWTSVNDLETYLNEFKQHSLRNPIVEQVVMETLRVVRDIWQQYGQGQASFFNEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSKENKTIKIFTEEQYRTFIKEHYSNNPEKTKKLLLEEIPEKMVARQMNDTCYISKFISEILSKIVRSDEQDEGVHSKNVILCTGKITSILRQDWGLNDIWDNLILPRFERMNNLLQKEKFTIYSIEKQKKIPVVPINDQFKSFQKKRIDHRHHAMDAIIIACTTREHINYINNQHALEKEKDKKEKQEERDKLREKLCIKKYNNRSEGNYSWIFKKPWDTFTQEVRVALEDIVVSFKQNLRVINKATNYYERWVEENGKYIKKMVKQEGTNWAIRKPLHEETISGKIYLDREKITKNDILTATRKTVDSSFDDKRIKKITDTGIQKILLNYLKYKGSPEIAFSPEGLEELNKNLSIYNDGKPHKPIYKVRIYEKGSGRFALGEKGRKYKKYVQGASNLYFGIYQGAKRSFATIPLNEVIERQKQGLPSVPEYNEKGDLLLFSLSPNDLVYVPIEGEIIENIDFRNLSKEQKERIYNVNDFSSTCYFTPNRIAKAIFPKEVDLQRKGDKLSGSYDTKTASLEGIQIKEVCIKLKVDRLGNISKA

SEQ ID NO: 144 - protein, 1426 aa, Capnocytophaga ochracea
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 145 - protein, 1437 aa, Capnocytophaga sp. CM59
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 146 - protein, 1471 aa, Capnocytophaga sp. oral taxon 324 str. F0483
MCKYFYIKNFITFVLSKSIIPMKHILGLDLGSNSIGWAFVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDAPIKVCAKSNPYYQEFRVLQWLQNLRIYEIETDREVTAEFIETPQDCEALFNFLMSQKEIDNKGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENESTNLRIKKLLAELKEDASIQNVRPYSLVQQELLKIYEEGVFSATDEVEEDIQKIRKKAEPSKADLQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNKLILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWSTFTQEAKEALEHIVVSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSTEGLEELNKNIAQYNNGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 147 - protein, 1450 aa, Capnocytophaga sp. oral taxon 326 str. F0382
MKRILGLDLGSNSIGWAFVEQDFENKQGKIIATGSRIIPMDQGILGDFEKGNTVSQTAERTTYRSMRRLRERHLLRRERLHRVLHILGFLPPHYDAQIDFTKRYGKFIDNAEPKIAYNNGNFIFMNSFNEMIEDFKKYQPQLFYKKSNGEESKIPYDWTIYYLRKKVLSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTFIKVCAKSNPYYQEFRVLQWLQNLRIYEIETDREVTAEFIETAEDYEALFNFLMSQKEIDNEGLLKYFLFAKNPQIKDKVAKSELKKWLTTYRWNYVYDAADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSESCFQGLPLWLAQYVVYNRHAEATDIEKWTSVSDLETYLEDFKQHSLRNPIVEQVVTETLRVVRDIWQQYGGGQANFFDEIHIELGRELKKTAEERKQLSNRNQENENTNLRIKKLLAELKEDASIQNVRPYSPVQQELLKIYEEGVFSSTDQVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRFQKNLPTVPIEYSQGFQKKRIDHRHHAMDALVIACATREHINYMNNQHALDKNKDKKEKQQSRIDLRTILCEKKNNNWQFKKPWSTFTQETKEALEHIVVSFKQNLRVINKATNYYEKWEEKNGVLVKKKVKQEGTNWAIRKPLHKETVSGKIVLDRKIGKDKILTATRKEVDITFTEKIISSITDTGIQKILLNYLNYKGSPEVAFSAEGLEELNKNIAQYNDGKKHQPIYKVRIFEEGSKFPLGETGAKATKFVEAAKGTNLFFGVYQGKEKRSYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 148 - protein, 1435 aa, Capnocytophaga sp. oral taxon 329 str. F0087
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 149 - protein, 1426 aa, Capnocytophaga sp. oral taxon 335 str. F0486
MKNILGLDLGTTSIGFTHIVEDENKEKSEIKELGVRIVSLTTDEQSDFEKGKSISTNANRTLKHGARLNLDRYQQRRKFLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQKEFDLVWNFQKQFYPDILTDSFYKELQGKGKDATSKAFSKRYHFDTAENKGSRESVRLQAYQWRAEAISKQLSKEEVAYVLTEINNNLNNASGYLGAISDRSKELYFNRQTVGQYLYAQLQENKHNSLKNKVFYRQDYLDEFERIWETQASFHKELTEELKKQIRDVVIFYQRKLKSQKGLISFCEFESKEIEIEKDGKTITKSIGARVVPKSSPLFQEFKIWQILNNVTCKRKGIRKKKSSAKSTELDLFNEPSQTIFSLDMECKQLLFEELNLKGDLKSDKVLKLLGYSPQEWEINYNQLEGNRTQKALYEAYLKIVEMEAHDVKDILQIKSTKDDWALEESPLSASEIRERVKAIFQTLGICTKILYFDPLLPVKEFEEQDSYQLWHLLYSYESDDSTSGNETLYRILEKKYAFKREHATILANVTLQDDYGSLSTKAIRKIYPYIKENQYSTACEKAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISGILQKEFGIKNPTKSDITRYRLYQELAHNGYNDLYTNTYIPKELLFSKNIDIEHIVSKARVFDDSFSNKTLAFREFNIKKGESTAFDYITSLNNEEELNQYLNRVENAYKTKNISPAKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDKNNKNYSVILAIEEKETIKVPTNNGKNKRVFIEPIPNFRQVAKKHLEEIFISHKAKNKVVTKNTNKPAGTDKQQITLTPRGQLHKETVYGKYQYYVNKEEKIGVKFDKETIAKVSNPVYREALLKRLQANDNDPKKAFAGKNALSKNPIYLDEAKTKTLTEKVNLTYLEEDFSIRKDISPDNFKDLKSIEKVIDQGVKRILIKRLQDYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFEAVVGAQQGLPIVDKTYKQAEGWQFLFTMKQNEMFVFPNEATGFNPAEIDLLDPKNKKQISPNLFRVQKIATKDYFFRHHLETNVDTDNVLKNTTWKREGLSGLKDIVKVRINHLGDIVSIGEY

SEQ ID NO: 150 - protein, 1432 aa, Capnocytophaga sp. oral taxon 380 str. F0488
MKNILGLDLGTTSIGFAHIVEDENKEKSEIKELGVRIVSLTTDEQSDFEKGKSITTNANRTLKHGARLNLDRYQQRRKYLIDLLHKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTAENKGSKESVRLQAYQWRAEAVSKQLSKEEVAYVLTEINNNLNNASGYLGAISDRSKELYFNRQTVGQYLYAQLQENRHNSLKNKVFYRQDYLDEFERIWETQALFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSTKDDWSLDESPLSASEIRESVKAIFQALGICTKILYFDPLLPVKDFEEQDSYQLWHLLYSYESDDSTSGNETLYRILEKKYAFKREHARILANVALQDDYGSLSTKAIRKIYPNIKENQYSTACEMAGYKHSKLSLTTEELEARELKNIIPLLKKNALRNPVVEKILNQMINVVNALIEKNSERDAEGKITKYFHFDEIRIELARELKKNAQKRYEMTQNINKAKSEHQKISEILQKEFGIKNPTKSDIIRYRLYKELEHNGYKELYTNTYIAPDVLFSKNIDIEHIVPKARVFDDSFSNKTLAFKDFNIKKGESTAFDYITSLKNEEKLNQYLARVENAYKTKNISPAKYKNLLKKASEIGDGFINRDLRDTQYIAKKAKEILFQVTKNVLSTSGSITDRLREDWSLVDVMKELNMPKYQSLGLTEVEERKDGNKVTVIKDWTKRNDHRHHAMDALTVAFTKPSYIQYLNHLNARKDENNKNYSVILAIEKKETIKVPTNNGKNKRVFIEPIPNFRQVAKKHLEEIFISHKAKNKVVTKNTNKPAGTNKQQITLTPRGQLHKETIYGKYQYYVNKEEKVGVKFDKETIAKVSNPLYREALLKRLQANDNDPKKAFTGKNALSKNPIYLDEAKTKTLPEKVNLTYLEEDFSVRKKIVPKNPTSKEFVPNLKSIEKVVDEGVRNILIERLRVYNNDPEKAFVDLEKNPIWLNKEKGIAIKRVTISGVNNAQPLHIGKDHLGKTTLNKEGKEIPVDYVSTGNNHHVAIYRDKEGNLQEQIVSFFEAVVRTQQGLPIIDKTYKQEEGWQFLFTMKQNEMFVFPNEATGFNPAEIDLLDPKNKKQISPNLFRVQKIATKDYFFRHHLETNVETDNVLKNTTWKREGLSGLKDIVKVRINHLGDIVSIGEY

SEQ ID NO: 151 - protein, 1450 aa, Capnocytophaga sp. oral taxon 412 str. F0487
MKHILGLDLGSNSIGWAFVQQDFENKQGKIIATGSRIIPMDQGILGDFERGNTVSQTAERTTYRNTRRLRERHLLRRERLHRVLHILGFLPPHYDSQIDFTKRYGKFIDNAEPKIAYNNGNFIFMNSFNEMIEDFKKYQPQLFYKKSNGEESKIPYDWTIYYLRKKALSQKITQQELAWLILHFNQKRGYYQLRGEEETENPNKEVAFHSLEVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTAEFIETAQDNEALFNFLMSQKEIDNESLLKYFLFAKNPQIKDKVAKSELKKWLTTYRWNYVYDAADNSSKKYPMNETGYELQQYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSETCFQGLPLWLAQYVVYNRHAEAADIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRFQKNLPTVPIEYSQGFQKKRIDHRHHAMDALVIACATREHINYMNNQHALDKSKDKKEKQQSRIDLRTILCEKKNNNWQFKKPWSTFTQEAQEALEHIVVSFKQNLRVINKATNYYEKWEEKNGVLVKKKVKQEGTNWAIRKPLHKETVSGKIVLDRKIGKDKILTATRKSVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKIEYSPLNKMERDILGTMIKEVCIKLKVDRLGNITKA

SEQ ID NO: 152 - protein, 1426 aa, Capnocytophaga sputigena ATCC 33612
MKNILGLDLGITSISFAHIVEDENKEKSEIKELGVRIVSLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQREFDLVWNFQKQFYPDILTDSFYKELQGKGKDATSKAFSKRYHFDTAENKGSKESVRLQAYQWRAEAISKQLSKEEVAYVLTEINNNLNNASGYLGAISDRSKELYFNRQTVGQYLYAQLQENRHNSLKNKVFYRQDYLDEFERIWETQASFHKELTDELKKQIRDVVIFYQRKLKSQKGLISFCEFESKEIEIEKDGKTITKTIGARVVPKSSPLFQEFKIWQILNNVTCKRKGIRKKKSSAKSTELDLFNEPSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIKEKVKDIFQALGICTKILYFDPLLPVKEFEKQDSYQLWHLLYSYESDDSTSGNETLYRILEKKYAFKREHARILANVALQDDYGSLSTKAIRKIYPNIKENQYSKACELAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKKFGIKNPTKSDIIRYRLYQELEHNGYKELYTNAPIARDMLFSKNIEIEHIVPKARVFDDSFSNKTLTFHRINSNKGEYTAFDYITSLNSEEELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNVNKPAGTDKQQITLTPRGQLHKETIYGKYQYYVNKEEKVGVKFDERTITKVSNPLYREALLKRLQANDNDPKKAFTGKNALSKNPIYLDETKTKTLPEKVNLTYLEEDFSIRKDISPDNFKDLKSIEKVIDQGVKRILIKRLQDYDNDPKKAFVDLEKNPIWLNKEKGIAIKRVTISGVSNAQPLHIGKDHLGKTTLNKEGNEIPVDYVSTGNNHHVAIYRDKEGNLQEQIVSFFEAVVRTQQGLPIIDKTYKQEEGWQFLFTMKQNEMFVFPNATTGFNPAEIDLLDPKNKKLISPNLFRVQKIATKDYFFRHHLETNVETDNVLKNTTWKREGLSGLKDIVKVRINHLGDIVSIGEY

SEQ ID NO: 153 - protein, 1140 aa, Catellicoccus marimammalium M35/04/3
MKNMTKVNVGLDVGISSAGWSVINAETNQILESGVRLFSGSDADENVNRRNQRQGRRLFRRRKLRIQEAKKYLENVFQLKDIEPKDEWNPYEIRVRALNEKVSKEELSIALLNIVKHRGISYELEDVTDEEGTNTQSFQSGLDYNRRLLKTKTVGEIQYDRLQKYGQVRGQIQTEDGLLINIFPTKNYVEEVERILETQKKYHPEIDDVFIEKIISFVTRKREYFVGPGNEKSRTDYGIYRENGETLDNLFEILIGKDKFYPEEYRAAGSSYTAQIFNLLNDLNNLRIPTTEDHHLTKAQKEEIITELKNTSRLSGGMLKLISKVTKAPKEEISGYRKDEKDKPDLHSLAYYRKQKNMLEKEGIQIADFSEELLDELATMMTLNTEPGEIRKQLNKITNQYDILTPEVIEVLVKNHTAFVATSNHKWHRFSLKLMKEFIPELLETSKEQSTILCERGFIQNRASYLDENHHFNYAELRENLYNPVVRKSTCEMLKVFTAIQEKYPNIQNVIVELPRETNEDEQKRKIKKINDNNAKRKKEILKEAQAQSGLSEEALEEKLLKTKGLYLKLMLWYEQEGKCVYSGQEIPLSDLLQNKGGYEVDHIIPISISFDDRLCNKVLVRQQLNSQKSNQTPFEYMTTHTDGHLSFHELKELVGKNKRFSKEKRELLLAEIYSNDIETRKRFINRNLVDTSYTARIVLNALQQYKKENQLSMNVSVVRGAMTNILRKKVKLDKTRETFHHHAIDASLMAVIPNIEFFKERKEWLPKSANEEVVEVEVSEEETMPEKEFKVKMRLPESFIQDVQILQRNSFAKEEVSGPQTRERNLKIKFSHQVDQKMNRKVADDTIYGTRQAQLGKDKKEETYVIGKIKDIYNYDEYVRFKKRYDKNKESFLMYHHDPQTFEKLEEILAQYPEYIEDEKGKKKKVSPFALYREENGPVTKYAKKNNGPVIKQLKYYDSKLNRKIDISHKYSTKNRQVVLQSLKPYRTDVYRNQDTGEYTLVGIDQNDGKFVNGHYGIPKSRYEEIKANNKLSEHDEFVFSLYKNSMVKVIDENGESIVVRYLSRSMPNRKNNAEIKPVEKYQFEDGEVVPVYGKCRKQMQTVFVKKGWTLLKGNTDILGNTYFVEKESENPKKMIDDK

SEQ ID NO: 154 - protein, 1329 aa, Catenibacterium mitsuokai DSM 15897
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 155 - protein, 1419 aa, Chryseobacterium sp. CF314
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 156 - protein, 1021 aa, [Clostridium] cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 157 - protein, 1065 aa, Clostridium perfringens C str. JGS1495
MNKDINYALGLDIGITSVGWAVINLDLNRIEDLGVRIFNAAENPKDGSSLALPRRLARGRRRLLRRKAYRVERVRKLIVKNNILTKEELEGLFKNKEVIDVWEARVKGLDYKLSREEWAKILINFCKRRGFKSNRKNETKDKEAGQILSSISYNIEKMKETNSRTIGEYIYNEVKNSDDSYAPLRNKFGEYKMCVSRDVLREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEDELFSTLTYSIDKDISKTENTKFVSLKGYHEIKRAIEKGVSKKAWQDIENNRNLLNDIAYVLTLGKTDDEIEKQLRLRNVPEELFESLLDMSFSKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTAVEVLKYRLWEQQRGECAYTQSQIALERLFSPGYCEIDHIIPFSRSFDDSLSNKILVLGSENQRKGNKIPYEYFGEDSERWNSFEIWVKGSYLNYKKKANLLKKKFTEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKLPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAAPFKDGIPMNEGLVAKEGMVRIDIYEKEGKYFVVPVYRYQLAKGIVPKRAAIAGKSELKWPIMDQTYNFKFSIFKNDLIEIKYAKKDGYFGYYDGFDRHTASLVIENHDNSDRYRGIGVKTGVVEFNKYEVDVLGNYHKVNLGGN

SEQ ID NO: 158 - protein, 1065 aa, Clostridium perfringens D str. JGS1721
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 159 - protein, 1116 aa, Clostridium spiroforme DSM 1552
MVEFLLKEMKIMGRLVLGLDIGITSVGYGVIDIDKNEFVDYGVRLFKEGTAINNEERRSKRGARRLKRRKTNRIADMKKLLERNGLIDEQYTALNNPYEIRKKGLKNKLSNYELATAILHITKNRGTCLESNADETQDEESTKNILSKNALELKDKYICEIQLARLEESGKIRGINNNFKTEDYLKELSKILENQDLEKETIDKIKEIVARRRRYDQGPGSEKSPTPYGSYRMENGELVHVNLIDMMRGKCSVFPDQLRAPQQSYSAELFNLLNDLNNLKINGEKLSSTEKQKIIDFVNEKGGITVKQLLKLIDVGITEISGFRIDKNEKPLITEFKGYKKVLKVFKNYNQESLLNDKSIVDTIMDINTKIKSIDERSDQLKQVLPSLDTSIINDLASIKGVSGYHSLSLKALNLINNEMLKTEMNQMQVLHQLDIFDKNRVSLKGQRQIYADDNAILSPVAKRAHRETFKVINKLRSIYGEFDSIVIETTRDKNTQDQKKRIKNNQKNYEERNTEVNNFLKEAGYNPENINAKTKMKIRLYIEQDAKSAYTLQDINLKELIEDEKAYEIDHIIPISISLDDSFNNKVLTTHDENQEKGNLTPISAFLKGKFHNGNLNTYKVFIQNNKNLNRKKKEYLLCEDDITRYEVVQNFINRNLVDTSYACRTVMNTLVHYFKDNEINTKVHTIKGQATSTFRKRIGLIKDREEDYFHHAIDALIVASLKKMNLINSYLMKVDFNEMYDEETGEIFNVLPDNSYLDEKYISFVSNLKNIYEESNKYIRGVMIKEKMTYPLIKVSHKIDTKPNRKISDDTIYSTRNVDNQDMLVERIKNIYDPKENAANTLINDIINDNTDKYIMYHKDPQTFDKIKAIVLNHFNEFKTDKNCYIVTKEGLYKLKGTSPLALYYEEFGPITKYAKKNNGPTIHSMKFYSEKLGNHLSITHKYSTVNKKVITKQISPYRTDFYQSPEGKYKFVTVRYKDVAYNAKKDKYIIDHSWYREQKKLKKIADEWIFVCSVHRDELIGIMKADGQKRIFDSSTESDGETLYHDAKTYEILKFTATNNDITGRFEVKPIYCYCKKQLMVSIGTCRKIQKFATDVLGNLYIVKDNVLKLEFK

SEQ ID NO: 160 - protein, 1338 aa, Coprococcus catus GD/7
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 161 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 162 - protein, 1099 aa, Corynebacterium accolens ATCC 49725
MSLSYRVGIDVGTYSLGCTAIEVDDNDQPVNILSSVSLIHDSGLDPDQQKRAVTRLASSGVARRTRRLYRRRRRRMINLEKFLTSQGWETRPFEHYSDPYLPWNARVALVNGYISDDAQRGMYLSIAFRHIANHRGWRNPYWKVSSLYSPDKPSDAFEQIRKELEESTGHKIPETVTVGQLISFAQFGKDRLRGGGKKKDEKKPQEQVNQAVISARLHQIDHAREINEICRVQKIDDALRKQILDLVFAAESPKGAQIGRVGKDPLQPKLPRALKASDAFQQYRIVALAGNLRIYRDGVSTPLDRDEKLIVFNYLINLSHKEEPSWLKVAEVLNIDRGQLHGTATMTDDGERAGAAPPVHDTNRTILGCKIKPLVHWWEGANDDERAAMLKALSNSEVEDFDSPAGAQTQAFFANLDESEQEKLDSLHLPIGRAAYSEDTLMRLTSRMLDENLDLYEARLAEFDIPKDWAPPAPRIGEPVGNPAVDRVLKGVARWLEAAADEWGAPKSVVIEHVRDGFISKSKANEIDRANNARHKRNRELFKQMQENLGIDGKLRSSDLWRYQSVQRQNCQCAYCGSPITYTTCEMDHIVPRAGEGSTNTRDNLVATCHRCNLAKKNIPFAVWAAQTNIPGVSVKEALDRTRHWSEDSGMTSKDFKKFRKNVCDRLKRTVVDEPLDARSMESVAWMANELRGRVAQRFQEENTVVNVYRGELTAEARRAAGISDKLRFIDGTGKSRLDRRHHAVDAAVVAFTQNYVAETLAIRSNKKREAQLLQAAEQWKEFTGSDAEHRAAWNAWLPKMQKLAVLLQKALDEDRIAVTSNLRLRLGNGRAHEDSIGELKTIRVGDAISVTDIDRASSEALWCALTREPDFDENNGLPENPDRRIRIHGTWYDAEDDIEVFPVGAGAIKVRGGYAELSRFHHARIYKIPGKKAPVYCMLRVYNADLIRHRHEDLFSVEIKPQTMSVRQAEPKLRKALAENTAEYLGWLVTDDELVIDTSNFNTGQIAEMQSELGQVRRWRLDGFYSPSTLRLRPLQMSAEGLREDTSIGAKKIIDRPGWLPAINKLFGEGHVTVVRRDALGRARLTSNAHLPISWKAE

SEQ ID NO: 163 - protein, 1099 aa, Corynebacterium accolens ATCC 49726
MSLLYRVGIDVGTYSLGCTAIEVDDNDQPVSILSSVSLIHDSGLDPDQQKRAVTRLASSGVARRTRRLYRRRRRRMVKLENFLTAQGWETLPFERYSDPYLPWHARVALVNGYISDDTQRGQYLSIAFRHIANHRGWRNPYWKVSSLYSPDKPSDAFEQIRKELEASTGRQIPETATVGQLISFAQFGKDRLRGGGKQKDKKKPQEQVNQAVISARLHQIDHAREINEICRVQKIDDTLRKQILDLVFAAESPKGAQKGRVGKDPLQPKLFRALKASDAFQQYRIAALTGNLRIYRNGVTVPLDRDEKLIVFNYLVNLPKKEEPSWLKIAEILNIDRGQLRGTATMTDDGERAGATPPVHDTNRTILDSKVKPLAHWWENASDDERAAMLKSLSNSEVEDFDSPAGAQVQAFFADLDETEQEKLDSLHLPMGRAAYSEDTLMRLTNRMLDENLDLYEARLAEFGIPKDWAPPAPRIGEPVGNPAVDRVLKGVARWLEAAADEWGAPKSVVIEHVRDGFVSKSKAIEIDRANNNRHKRNRELFQKMQENLGIEGKVRSSDLWRYQSVQRQNCQCAYCGSPITYTTCEMDHIVPRAGEGSTNTRDNLVATCHRCNLAKKNIPFAVWAEKSTIPGVSVKEALDRTRHWSEDSGMSKKDFQKFRKNVCERLNRTVVDEPLDARSMESVAWMANELRGRVAQRFQEENTTVNVYRGALTAEARRAAGITDKLRFIDGTGKSRLDRRHHAVDAAVVAFIHNYVAETLAIRSNKKREAQLLQGTSQWKEFTGSDDKHRAVWNAWIPKMQKLAVLLQIALDEDRIVVTSNLRLRLGNGRAHEDTISELKTIRVGDAISVTDIDRASSEALWCALTREPDFDEKDGLPENPNRRIRVHGTWYDAEDEIEVFPVGAGAIKVRGGYAKLSRFHHARVYKIPGKKAPIYCMLRVYNTDLVQHRHEDLFSVELKPQTMSVRQAEPKLRKALAENTAEYLGWLVTDDELIIDTSTFRTGLIEEMQSEFGLVRRWRLDGFDSPSLLTLRPLHMSAEGLPDDCALGSRKIIDTKGWRVSINKVFNAGNTTVVRRDALGRARLTSNAHLPISWKEE

SEQ ID NO: 164 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLKSATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 165 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 166 - protein, 1084 aa, Corynebacterium diphtheriae
MKYHVGIDVGTFSVGLAAIEVDDAGMPIKTLSLVSHIHDSRLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNIQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRVTMDEEIDARSMESVAWMANELRSRVAQHFASRGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 167 - protein, 1084 aa, Corynebacterium diphtheriae bv. intermedius str. NCTC 5011
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMQRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSPDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLGSQLSVSDIDKASSEALWCALTREPDFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 168 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 169 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVWVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPERAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRATWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 170 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 171 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDSFQRYRIAALISNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVRDGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKELAPELSKIIDRPGWLPAVNKLFSEGNVTVVRRDSLGRVRLESTAHLPVTWKVQ

SEQ ID NO: 172 - protein, 1089 aa, Corynebacterium matruchotii ATCC 14266
MNSANVNYRVGIDVGSYSLGMAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQAGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 173 - protein, 1069 aa, Corynebacterium matruchotii ATCC 33806
MAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQVGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 174 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 175 - protein, 1332 aa, Dolosigranulum pigrum ATCC 51524
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 176 - protein, 1340 aa, Dorea longicatena DSM 13814
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 177 - protein, 1380 aa, Eggerthella sp. YY7918
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 178 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 179 - protein, 1337 aa, Enterococcus faecalis ATCC 29200
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 180 - protein, 1337 aa, Enterococcus faecalis ATCC 4200
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYIGPLSKGDASTFAWLKRQSEEPIRPWNLQETVDLDQSATAFIERMTNFDTYLSSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 181 - protein, 1337 aa, Enterococcus faecalis D6
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 182 - protein, 1337 aa, Enterococcus faecalis E1Sol
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 183 - protein, 1150 aa, Enterococcus faecalis Fly1
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDRLIGKDFQGELRASGLSLSAQQYNLLNDLTNLKIDGEIPLSPEQKEYILAELMTKEFTRFGVNDVAKLLGVKKERLSGWRLDKKGKPEIHTLKGYRNWRKIFAESGIDLATLPTETIDCLAKVLTLNTEHEGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANHETKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 184 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 185 - protein, 1150 aa, Enterococcus faecalis R508
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINVQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTPFVKVSRYHYAVKEETGEKVMREIDFETGEIVNEMSYREFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEIMPAENQFKQKPYNNGAINLNIAKYGKEGKKLRKFNTDILGKKHYLFYEKEPKNIIK

SEQ ID NO: 186 - protein, 1150 aa, Enterococcus faecalis T11
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLAMLPTETIDCLAKILTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 187 - protein, 1150 aa, Enterococcus faecalis TX0012
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 188 - protein, 1150 aa, Enterococcus faecalis TX0012; identical to SEQ ID NO: 187

SEQ ID NO: 189 - protein, 1337 aa, Enterococcus faecalis TX0470
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 190 - protein, 1150 aa, Enterococcus faecalis TX1342
MYSIGLDLGVSSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGINDVAKLLGVKKERLSGWRLDKKGKPEIHTLKGYRNWRKIFAESGIDLATLPTETIDCLAKVLTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKNNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 191 - protein, 1337 aa, Enterococcus faecalis TX4244
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENLGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 192 - protein, 1339 aa, Enterococcus faecium 1,141,733
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 193 - protein, 1340 aa, Enterococcus faecium 1,231,408
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 194 - protein, 1339 aa, Enterococcus faecium E1133
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 195 - protein, 1340 aa, Enterococcus faecium E3083
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 196 - protein, 1340 aa, Enterococcus faecium PC4.1
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 197 - protein, 1340 aa, Enterococcus faecium TX1330
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 198 - protein, 1340 aa, Enterococcus faecium TX1337RF
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 199 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 200 - protein, 1330 aa, Enterococcus italicus DSM 15952
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 201 - protein, 1096 aa, Eubacterium dolichum DSM 3991
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 202 - protein, 1114 aa, [Eubacterium] rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 203 - protein, 1391 aa, Eubacterium sp. AS15
MENKQYYIGLDVGTNSVGWAVTDTSYNLLRAKGKDMWGARLFDEAKTAVERRTKRTSRRRSEREKARKAMLKELFADEINKVDPNFFIRLEESKFFLDDRSENNRQRYTLFNDAKFTDKDYYEKYKTIFHLRSALINSDEKFDVRLVFLAILNLFSHRGHFLNASLKGDGEIQGVDIFYNDLYEVCEEFEIDLPQISNIDNFEKILSQKGKSRTKILEELSEELSISKKEKIKYSLLKLICGMKIKVVDIYADEDIQEDDKKKDLGFRESDYEKSSLEVKEIIGDDHFELIERAKAVHDIGLLANIIGNSKYLCEARVEAYDNHHKDLQKIKELLKKYDIKAYTDMFRKMTDKNYSAYVGSVNSNIAKERRSVDNRKIEDLYEYIKKIALKNISDDNEDKIEILKKIETGEFLKKQLTASNGVIPNQLQSRELRAILKKAENYLPFLKEKGEKNLTVSEMIIQLFEFQIPYYVGPLDKNPKKDKNANSWAVIPSGGRILPWNFEDKVDVKGSRKEFIEKMVRKCTYLSEEHTLPKQSLLYEKFMVLNEINNIKIDGEKISVEAKQKIYNDLFMKGKKVSQKAIKQELISLNIMSKDSVLSGIDTVCNAYLSSIAKFRGVFDENVNNQSTIDMIEDIIFLKTVYSDEKRFVKEEIVEKYGDEIDKDKIKRILGFKFSNWGNISKSFLELEGADVGTGEIRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYSAIKEDSKQWVKELDAKDESYFRSKKMYLYYLQKGRCMYSGEVIELDKLMDDNLYDIDHIYPRSFVKDDSLDNLVLVKKEINNRKQNDPITPQIQASCQGFWKVLHEQGFISNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPAYKYHMDRFFERDVKSKSEVAWIGQSEGNAGTIAIVKKTMSKNSPLITKKVEEGHGSITKETIVGVKEIKFGRNKVEKADKTPKKANLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 204 - protein, 1107 aa, Eubacterium ventriosum ATCC 27560
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 205 - protein, 1391 aa, Eubacterium yurii subsp. margaretiae ATCC 43715
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 206 - protein, 1142 aa, Facklamia hominis CCUG 36813
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 207 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 208 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 209 - protein, 1347 aa, Finegoldia magna ACS-171-V-Col3
MKSEKKYYIGLDVGTNSVGWAVTDEFYNILRAKGKDLWGVRLFEKAKTAADTRTFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEAVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRIKGKPLDTDVKLKLIEELFKKKTKVTLKSIRDYMIRNNFADKEDFDNSEKNLEIVSNMKSYIDFNNILGDKFELEMVEDLIEKITIHTGNKTLLKKYIEETYPDLSSSQIQKIINLKYKDWGRLSRKLLDGIKGRNKTDDVNTVINFMRNSSDNLMQIIEGKNYSFNEYIDNLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDESELRSKKLYLYYTQMGRDMYTGEKIDLDKLFDSTHYDKDHIIPQSMKKDDSIINNLVLVNKNANQTTKGNIYPVPSSIRNNPDIYNYWKYLMEKEFISKEKYNRLIRNTPLTNEELGVFINRQLVETRQSTKAIKELFEKFYQKSKIIPVKASLASDLRKDMNTLKSREVNDLHHAHDAFLNIVAGDVWNREFTSNPINYVNENREGDKVKYSLSKYFTRPRKSKGKVIWTPEKGRKLIVDTLNKPSVLISNESHVKKGELFNATISGKKDYKKGKIYLPLKKDDRLKDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 210 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 211 - protein, 1348 aa, Finegoldia magna SY403409CC001050417
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 212 - protein, 1516 aa, Flavobacteriaceae bacterium S85
MLKQQKDKIIGMNKKILGLDLGTNSIGWALVKQDLENKYGEIIGCGSRIIPMSQDVLGKFDAGISISQTAERTNYRSVRKLIQRNTLRRERLHRVLHQLDFLPKHYNDSIDFEKKLGQFKTDKETKLNYFVNQHGKHEFLFKDSFNEMVKEFKEEQPELFYIKNNGKETKIPYDWTIYYLRKKALSKKISKEELSWLVLNFNQKRGYYQLRGEIDEEKEKNKRYEKLYVSEVVKTNNTIKKTGEYLYDIYFDNGWKYEKQTTKPQDWLHKHKEFIITTTTLKNGETKRTFKTVDSEKDWIAIKSKTEQDIKESNKTVGAFIYDTLLKNPTQKIRGSLVKTIERKFYREEFEKILKEQIKHRPEINVNTAIGKENYTKCVTELYPRNEAHANNILTNDFNYLFTKDILFYQRPLKSKKSEIANCQYEYRTYIKKKEKTGKEERVKQPLKATPKSHPLFQEFRLWQFIHNLKIYIRETTVGNKPLFDVDITDTFFTSENDWATLFEYLNNKKEIEQKHVLEYLVSKKIISKSEKTDYRWNYVEDKKYPGNETRVDFINRLKKVENLNVDEFLTSELEFKLWHIIYSVTDKNEYEKALENFAIRQNIDKDSFVNSFKKFPPFKSDYGAYSTKAIKKLLPLMRLGKFWDGSEIPKVVVEKITDIKTRLTSVNYDESLFKKDEKKILETIVDDITPKQLLKSFVKLKGKNHLAGLNTYQACYLVYERHSESSDITQWENPDDIDSFLNHFKQHSLRNPIVEQVVTETLRTVRDIWKYYGNGSPNYFNEIHIELGREMKNPADKRKQMSAKINENENTNQRIKGILQELMNDGVQDIKPYSPSQQEILKIYEEGISQNPNVDYSKVSEDEITKIKKSNNPTLKEIQRYKLWLEQKYISPYTGKPIPLSELFTPAYQIEHIIPQSRYFDNSLSNKIICESEVNEDKSNKTAYEYLKTNGGSIVHGHHLLSLKEYEDHCQHYFKKNRTKLKNLLSEEIPEGFINRQLNDSRYISKLIKGLLSNIVREENEQEATSKNIVPVTGSITSKLKQDWGLNDKWNEIIAPRFKRLNKMTNSNDFGYFDEKINTFRIQVPDAISRGFNKKRIDHRHHTLDALVIACCTKKHIQYLNSLNNEIIKHELKPSILIKNAQGDYTKHFMLPWNNFPIDCKNAIENTIVSFKQNLRVINKTSNKYQSYKDENGNLRLGKDGKPKKGLTKQTKGNNWAVRKAMHEDTFYGEIVDGENKGKLKIKTLLDTSFDVKKIEDKVLDKSIRTILINYLKQDKYKNLSKPHEEAFSPNGIIEMNKNIISLNNNIPHKPIKRVTLKHEKGKKFSIKTLLDKKTKFAKSATGTNVFFCIYKNINGKIKYHTPSFEEIIEIQKQEFEIKYKSKLNVPETLFDKKESFELLFYLQPNDLVYLPNDEELKNRQLIDFNNLNKKQIKRIYKFTDGSGTTANFIPYQVAKVIFNLNKKEQAKSSFKYPIQNEFGVGSPQSKNQKSIEGILIKERCIKLKIDRLGNISKA

SEQ ID NO: 213 - protein, 1473 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 214 - protein, 1459 aa, Flavobacterium columnare
MKFNLGLDIGTNSIGWALVNEDYENKKGKIIAAGSRIIPMTQDILDKFGSGAITETQTALRTDYRSKRKLIQRFLLRRERLHRVLNVLDFLPKHYAESIDFEKYFGKFLPNTEPKLAYNQNQFIFQNSFLEMLKEFQEKHPELLTNNKKIPYDWTIYYLRKKALNQRIEKEELAWLLLQFNQKRGYNQLRDEEEESVPNKQVEFYSLKIIDVVADQPKEGRDKRWYSINLENGWTYRRESKTPLFNWEGKTKDFIVTTDLNQDGSIKKDKEGKEKRSFRAPSEGDWTLLKKKTEKEIYESGKTLGTYIYDALLNTPDLKIKGDFIRTIDRSIYKEELQQIINKQKEYHLELNSSKLYKACLEELYPKNEIYKSALKNKDIAYLFINDILYYQRPLKAPKYNIGKCTYESRTFKKEDKKIREYIPAVAKSHPLFQEFRLWQWIKNLKIYEKLSSDNCTDFFLTNEQDFENLFEFLWNKKEIDHKGILEYLVKTKFPDLKPKQVKTKVKEYRWNYVYDHEKDESKTYPCGETYFLLKNKLDKIYNAQDDFLDKERLYNLWHIIYSVTDKKQYEKALAKFALKNHLDTKSFVNTFKRIPPFKNDYAIYSLKAIKKLLPLMRVGKYWNYDDIDPITKQKIQCIITGEENDTISTLVREKTNHFSNENDFKNLPLWLAGYIVYNSHNESSEIEKWKSPQDIDTFLKKFKQHALRNPIVEQVVTETLRVVRDIWSKKGQGKKDFFNEIHIELGKDLKNPVDKRRKLSSTNTKNESTNTRIKALLIELFTQGVENVKPNSPKHQEILKIFEEGALNSGIEIEEDIIKISNTDQPTKKQLELYILWLEHKYKSPYTGQSIPLSKLFTPNYEIEHIIPRSKYYDDNLSNKVICETEINRLKNNQLGYEFINNHEIREVTLEEGKTIRLLSPEQYWNFVTTYYAKNKAKRENLLLKELPVQMVEKQLNDTRYVSKYVMQLLSKIVRKEDGTDNGINSTNILSISGKMTRALKNDWDLNDVWNDLLLYRFERLNTITKTNLFTTYSEQKQKRMPIVPDQYAKGFHKKRLDHRHHALDAIVIACITRNHINYMNNQNIQGEKLKKNAIEKENYREILQKSRLDIRAQLCEKKYNDNDPTKYNWVFIKPWADFTENTKDILESIIPSFKQNLRIINKTVNYYEKYNENGKKVKVRQIKGDNWAIRKPLHKETISGKVHLSYKTPAKGKILTATRKVLDSSMDFKSIEKITDTGIQKILKNYLEYKKSPELAFSPEGIEELNATITKYNNGFHHKPIYKVRIYEEGVKFPLGNKGNKKSKYVEAEKGTNLFFAIYKDQENNRYFETIPFNDVLETLKKGMSAVPEKNQEENTLVFALSPQDLVFVPTLDEIENPDIVDFKNLTKDQTNRIYKMVSSSGKQCFFIKAEVATSIVNKMEFSTSNKMENSIEGIQIKSNCWKLKLDRLGTITRVIK

SEQ ID NO: 215 - protein, 1535 aa, Flavobacterium columnare
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 216 - protein, 1354 aa, Flavobacterium psychrophilum JIP02/86
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 217 - protein, 1458 aa, Fluviicola taffensis
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 218 - protein, 1646 aa, Francisella tularensis
MNIKILPIAIDLGAKNTGVFSAFYQKGTSLESLDNKNGKVYELSKDSYTLLMNNRTARRHQRRGIDRKQLVKRLFKLIWTKQLNLEWNKDTQQTISFLLNRRGFSFITDGYSPEYLNIAPEAVKAILMSILDDYNGEDDLDSYLQSATENDSKIDELYNKLLQKALEFKLRKLCIDIKEDKVTTKTLKELSNTEFKLLANYLVDYDRILRTQKFSYTDKQGNLRELNYYHHDKYNIQEFLKRNIIINDVILEKLTDDLDIWNLNFDKFDFEKNLEKLENQEDKDYLQTHLHHFVFAVNKIKSEMASGGRHRSQYFQEITNVLVENNHQEGYLKNFCENLHNKKYSNLSVKNLVNLIGNLSNLELKPLRKYFNDKIHAKADYWDEQKFAETYSDWILGEWRVGAKDKDKKDGAKYSYKNLCDELKQKVGINQDGIINQTKSDFVDFLLELDPCRTIPPYLDNNNRKPPKCQSLILNPKFLDNKYPNWQQYLQELKKLQTVQNYLGNFEIDLKDLKSSKEQPYFVKYKSLNQQIASGQRDYKDLDARVLQFIFDRVKASDELLLNEIYSHAKKLKQNTSSELEKLELCKKLDEVIANSQLSQILKSQHVNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNQASKLEFDRKIKKFNSIYSFAQIQQIAFAERKGNANTCAVCSADNAHRMQQIKVAKPVEGNKDNIILSAKAQRLPAIPTRIVDGAVKKIATILARNIVDDNWDNIKQALSNNQQLHVPIITESNAFEFEPALADIKGKSLKDKRKKALERIDPENVFKDKNNRIKEFAKGISAYSDANLANGDFDGAKEELDHIIPRSHKKYGTLNDEANLICVTREDNQNRGNKAVFLYDLKPNYKLKQFNTTDDLEIEKKIADTIWDASKQDFKFGNYRSFINLTPQEQIAFRHALFLADKNPIKKAVIRAIDNRNRTFVNGTQRYFAEVLANNIYLRAKKENLATNRITFDYFGIETTNSNGRGIADVRKLYEKVDSDIQAYAKGDKPQDSYSHLIDAMIAFCVAADEHKNEGSIGLKMGNQYGLFPTPDKYDENTGEIISWHNDDIFRKIKVSDNQFSDKKLVRKKATEGFNTHRQMTRDGIYGESYLPILIHKNLNEVRKGYNWENSEEIKIFKGKKYDIQQLNNLVYCLKFVDKPISIDIQITTLEELRNILETNNISTTAEYYYINLKTQKLHEYYIENYNTALGYKKYTKEMEFLRSLAYRTERVKIKSIDDVSMILAKDSNFKAGKIELPFKTEWQRLYLEWQNTTIKDNHEFLKSYFSVKNATKQHKKVRKDFSLPISTNEGKLLVKRKTWDNNFIYQILNDSDSRADGTKPFIPAFDISKNEIVETIIKSFTSKNIFWLPKNIELQKVDNKSIFAIDTSRWFEVETPKDLIEIGVSTIQYKIDNNSRPKVRVKLDYVMDDDSKINYFMNHSLLKSRYPDKVLEILKQSTIIEFESSGFNKTIKEMLGMTLAGIYNETSNN

SEQ ID NO: 219 - protein, 1629 aa, Francisella tularensis
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINIQILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYRSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAITTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLANNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNITIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 220 - protein, 1629 aa, Francisella novicida FTG
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTTIEFESSGFNKTIKEMLGMTLAGIYNETSNN

SEQ ID NO: 221 - protein, 1629 aa, Francisella novicida GA99-3548
MNFKILPIAIDLGVKNTGVFSAFYQKGTSLERLDNKNGKVYELSKDSYTLLMNNRTARRHQRRGIDRKQLVKKLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGLKDQDKKEGAKYSYKDLCNELKQKVTNAGLIDFLLELDPCRTIPPYLDNNNRKPPKCQSLILNPKFLDNQYPNWQQYLQELKKLQIIQDYLESFETDLKVLKSSKDQPYFVEYKSSNQQIASGQRDYKDLDARILQFIFDRVKASDELLLNEIYFQAKKLKQKASSELEKLESSKKLDEVIANSQLSKILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQVYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 222 - protein, 1629 aa, Francisella tularensis; identical to SEQ ID NO: 26

SEQ ID NO: 223 - protein, 1629 aa, Francisella novicida GA99-3549
MNVKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSIKDRRKKALERISPENIFKDKNNRIKEFAKGISAYSGDNLASGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIVEIRQLYEKVDSDIQAYAKGDKPQASYSHLIDAMLAFCIAADEHRNDGSIGLEIDKNYSLYPLDKNTGEVFTKDIFSQIKITNNEFSDKKLVRKKATEGFNTHRQMTRDGIYAENYLPILIHKELDEVRKGYTWGNSEELKIHKGKKYDIQQLNNLVYCLKFIDKSISIDIQISTLEELRNILTTNNIATTAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 224 - protein, 1323 aa, Fructobacillus fructosus KCTC 3544
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 225 - protein, 1374 aa, Fusobacterium nucleatum subsp. vincentii ATCC 49256
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 226 - protein, 1367 aa, Fusobacterium sp. 1_1_41FAA
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 227 - protein, 1367 aa, Fusobacterium sp. 3_1_27
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKIIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 228 - protein, 1367 aa, Fusobacterium sp. 3_1_36A2
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 229 - protein, 1391 aa, Galbibacter sp. ck-I2-15
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 230 - protein, 1025 aa, gamma proteobacterium HdN1
MGGYMPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 231 - protein, 1397 aa, gamma proteobacterium HTCC5015
MTKNYISPIAIDLGAKFTGVALYQYLEGADCTQEVAKGLLVDDRGNVTWSQEGRRGKRHQVRGYKRRKMAKRLLWLILDSEYGIKREEVTEPLLKFINGLLNRRGYTYISEEVDEESMNVSPLPFSEMMPDYFNSSAPLLEQLAKLLSDKNKLVRFRAEGKIPSNKNEFKKLLDTALDGKYKDEKKELSEAWGNILIASENVLKSTVDGHKSRSEYLANIKEDIKSNEELEKQISSKEIDGFYNLVGHLSNFQLRLLRKYFNDPNMSGVSYWDEKRLEKYFYQWVQGWHTKGGTDEAEKKNIILKTKGAPLLKTLKSLSADLTIPPYEDQNNRRPPKCQSVLLSDEKLTMHYPKWKEWVGQLVKQNDNAYLNENVTLANALHRIVERSRSIDPYQLRLLISITDAEKRNDLAGYKRLKLSLGSEVDEFLLLVKNIVDETKEAREGLWFETENKLFFKCGKTPPRKEKLKSTLLSAVLGKNLSDDEQSSFIEEFWKSGTPKIERRNVRGWCRLASQVQKTYGVYLKEYGLQQLHKLEAGKKLDDKPLALLYKNSGLIASKIGEALNIEPDEVSRFASPHSLAQIFNIIEGDVAGFNKTCRACTYENIWRMQEEKVESLLTNQLLSEIHGERKVPLKSAMCTRLSADSTRPFDGQMASIIEHIARKIAQHKIAQINDVPKEFSIDIPIIIESNQFSFTAELEEIKRGRGSAKAKKAKELGEKSKAGWVSKTERIKTSSEGICPYTGAPLGGSGEIDHIIPRSLTGRTKKTVFNSEANLIYCSSKGNHDKGNRVYVIEQLNDKYLKKQFSTSDVNLIKKKIKTTIQRFTEGGEKLRSFSELSREDQKAFRHALFVPELKSEVTSLLAVKNITRVNGTQAWLAKKIASLLAEHLDKQGRDYTLSAHQIDPWSVSKQRKMLASAEPIWAKKDPQPAASHVVDAVCTFLEALEQPHTASRLKTISSTSFEKTGWRSALIPDLIKVDALDRRPKYRRYNIGSTSLFKDGIYAERFLPILIDENGLMAGYDIDNSLKAKGADVVFESLSPFLLFKGEEVGAQSLSDWQERIDGRYLYMSIDKVKAFDYLQEKVGEKDIAAELLNSIHFTQRKTELRAKFSDDSGKKMKTLDAIRKSLKLTVTVNEIGKRKEKCGFSGTIGIPAKSAWENLLDEPLLETYWGTKMPPQEIWEKVYRKHFPRNIPNQAHRKVRKDFSLPVVDSVSGGFRVKRKTPNGYNYQLLAIDGYSAVGFKKEGDNVDFKSPALVPQIAESKSVTPISSELVHLDKNEIVYFDEWRKIDISDSDLKQFVSSLELAPGSQNRFYIRFTVDEDQFERHFKSALRVNGIQDLDTVNKTFDWNREIPSLLIPPRSNLFLLETGQKITFEYIANGANAEVKKAYSLRRA

SEQ ID NO: 232 - protein, 1186 aa, Gardnerella vaginalis 1500E
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFIPWIFRAKLADEYIADEKQRKQMLSVAIRHIARHRGWRNPYQSIKSMTQETEYSEFYNELLKNIEKFAPGVGCEGSTPAQLVRDYLLLQQGKASRRLRITTDEKRKNHPNSLNPILPRKLMQSDNMLEILNIFNVQHIDDKYVREQIINAVFYAKSPRGSAENRVGKDAITGKGKRALKASLAFQKYRIISTISNLRIRENSKERCLTIEEKQSVYKLLTTSTDESSKEKSAEAPLYTWIDVADCLGIERYKLRGVGSQIGDGESVGNRPPMLNSELAIIYANNKSLGKSLLTWWLDANRTQEDKEALIEILSNTVDIEAIHDNPEYQDKYGSAIAFIDSMDETEIAALENISLPDGRAAYSLETLDKLNKQMLETDDDLFEARKKLFNLPNNWRPSEAPIAEPTGNPSVDRVLKIVHRFLISAKNRWGNPERINIEHVRSGFKSKKMANSYKELLDKRTKGKENLKAMMRNSLHLGMSDSISDADIRRYEAVQRQNGQCLYCGSEITYHTCELDHIVPRKGPGSTNTRENLVATCSLCNAQKCNTPFSTWCEQSTYCKNHDISVDSAINRVRAFIFPPNSYDKRGANQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYNNSSVHQYKVNALLKLHVGDEIDSGTIRRSSTPALYCALTRNPDYDVNNGLPENPNRAILLHDKKLNADDSITFFKAQAVQLFVREGSAEIGSSTHHLRIYEYFKKLKSGKIKKSYGMIRVFQNDLHRHIHEDLFSCDLPEQSISMRYADTEVAHAVQTGNSNYLGYLVPGDEIIVDFSHVKLSGNIGTFVEFLNKIGANCAAYNHWVVVGTDTEKVLILKPSMISSEGIDKLYSNCKRNNFDYSSYEKSINEILVGKGWRVSVNVLAKYNAETIRRNALGEVRWTSRSHLPISWSWNTGENRE

SEQ ID NO: 233 - protein, 1186 aa, Gardnerella vaginalis 284V
MEGNISYAIGIDVGLNSVGLAAIRLDDYGEPIRILKAMSVIHDAGIDPNGAKESDTRKAISGVARRVRRLYRQRRRRLQKLDFLLQSLGWPVVENKDLDFSDSFIPWIFRAKLADEYIADEEQRKQMLSVAIRHIARHRGWRNPYQSIKSMMQETEYSEFYNELLKNIEKLAPGVGCEGSTPAQLVRDYLLSQQGKASRRLRITTGGRRKNHPHSLDPVLPRKLMQSDNMLEILNIFNVQHIDDKYVREQIINAVFYAESPRGSAENRVGKDAITGKGKRALKASLAFQKYRIISTISNLRIRENSKERCLTIEEKQNVYKLLTTSIDKSSKRKSAEAPLYTWIDVADCLGIERYKLRGVGSQIGDGESVGNRPPMLNSELAILYANNKSLGQSLITWWLASNRTQEDKEALIEILSNTVDIEAIHDNPEYQDKYGSAIAFIDSMNETEIAALENISLPDGRAAYSLETLDELNKQMLETDDDLFEARKKLFNLPNNWRPAEAPIAEPTGNPSVDRVLKIVHRFLISAKNRWGNPERINIEHVRSGFQSKKMANSYKELLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEQSTYCKNHDISADSAINRVRAFIFPPNSYDKRGANQFKKEVIARLKQKVGDEAFDNRSIESVAWMANELHRRIDWYYNSQNYQTNNGISDISNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYSNSSVHQYEVNALLKLHVGDEIDSETIRRSSTPALYCALTRNPDYDVNNGFPENPGRTILLHNKKLNADDSITFFKAQAVQLFVREGSAKIGNSIHHLRIYEYFEKLKSGKIKKSYGMIRVFQNDLHRHIHEDLFSCDLPEQSISMRYADTKVAHAVQTGNANYLGYLVPGDEIIVDFSHITLSENIGKFVEFLNKIGADCTAYRHWVVVGTDTEKVLILKPSMISSEGIDKLYSNCERNNFDYSSYEKSINEILAGKGWRVSVNVLAQYKAATIRRNALGEVRWASRSHLPISWSWDTGENRE

SEQ ID NO: 234 - protein, 1186 aa, Gardnerella vaginalis 5-1
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFTPWIFRAKLADEYIADEKQRKQMLSVAIRHIARHRGWRNPYQSIKSMTQETEYSEFYNELLKNIEKFAPGVSCEGSTPAQLVRDYLLSQQGKASRRLRITTDDRRKNHPNSLDPVLPRKLMQSDNMLEILNIFNVQHIDNKYVREQIINAVFYAKSPRGSAENRVGKDAITGKGKRALKASLAFQKYRIISTISNLRIRENSKERCLTIEEKQSVYKLLTTSTDEYSKEKSAEAPLYTWIDVADCLGIERYKLRGVGSQIEDGESVGNRPPMLNSELAILYANAKSLKQSLITWWLAANRTQEDKEAFIEILSNTVDIEAIHDNPEYQDKYGSVIAFIDSMDETEIAALENISLPNGRAAYSLETLDKLNKQMLETDDDLFEARKKLFNLPNNWRPSEAPIAEPTGNPSVDRVLKIVHRFLISAKNRWGNPERINIEHVRSGFQSKKMANSYKKLLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEESTYCKNHDISVDSAINRVRAFIFPPNSYDKRGASQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLELLNEEMRADRIAVVNSIRLRYSNSSVHKDDVHALLKLHVGDEIDSETIRRASTPALYCALTRNPDYDVNNGLPENTDRTILLHDKKLNADDSITFFKSKAAQLFVREGSVEIGNSIHHLRIYEYFEKLKSGKVKKSYGMIRVFQDDLHRYIHEDLFSCDLPEQSISMRYADTKVAHAVQTGNANYLGYLVPGDEIIVDFSHVKLSGYIGEFVEFLNKIGANCAAYKHWVVAGTDDKTTLILKPSMISSEGIDKLYSNCERNNFDYASYEKSIDKILVDKGWRVSVNVLDQYKAATIRRNALGEPRWASRSHLPISWSWDTGENRE

SEQ ID NO: 235 - protein, 1392 aa, Gemella haemolysans ATCC 10379
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 236 - protein, 1385 aa, Gemella morbillorum M424
MKNKTWYLGLGVGPTSIGWAATDSNYKLLRKNKKRLWGVRLFEEAKTAVDRRTFRAERRRLARRKWRISLLEELFAKEVSKNDPNFFLRLKESKYHFEDKSLMNEYILFNDKDYTDKDYYKEYPTIYHLRLSLTTEENPDIRKVYLAVHSMLKNRGHFLLQGQSFNDSNIDSVIKELLELETVKINFEVTDEVIHSLKKIALEKKNLSDKNNDVKKLYPKEKQLQEIFKLVFGGKTSLDKLYDIEEYKELDNSVKSISFKEKVYEEVRPDYEQILSNYIELLDLAKLVYDSIVLADIKKEGKTISESKVELYNKHKDDLANLKKLVKIDSKLSEDKKKEVYFTIFKEDKEKGTNYVNYTHRSQEGKSCSYEDFKKFLKKELEKLEDSPTKTTILEELDLETFLPLQRTKDNSVVPYQIHKEELVKILDNAAKYHSFLAEKDDSGYSTREKVVQLFEFRIPYYIGPLNAHHNTENGGYSWAIRKKGMESVPVTPWNFKDVIDESASAEAFVNNLKNKCAYLSGEDVLPKNSLLYSEYALLNELNALRYEGNRISVEARDVIVTKLFKEQGKKVTKKTIKELLKTEGFIDGKGEIVGIDNIVKNDLKSYRDFKKILADKFDKERVENIILWITLYGESRKLIKEKITKVYGDFYTVDEIEKMSRLTYKDWGILSRKLLTELVSEKLYNEETGECLNIIGAMRQGTILFMELLADKFDYMSQIKNHNKENKDDITEITPDILENLHASPAVKRSIWQTVRIVEELKTIIGCVPTKIFIETTKRNNAPYKVPTLNRNDLVTKYKTIREHEIFELEKELKNTLDFTLNKNRLINEEPSKLKATKLYLYYTQLGRCMYTGKKIDLGELFDNNNKYDIDHIYPQSKVKDGSFNNIVLVTKASNDMKADVFPLKSKFQTKENKIFWRFLKEKKLITEEKYNRLVRTEEFSNGELTGFITRQLVETSQAIKVISNVLRELNPETTICYSKAENVSSFRQSFGKIKEANRKAENNEKLIRVQEINDYYNAKDAYLSIVVGNVYDVKFTRNVHNFIKNNKDARRYSLNGLFYTDVKNANTIAWEMDKTVHVVEKTMNNNNILITRRTSEQKGALYDATLYKAKVAEKAKEGTYYPLKTTDSKIKDVGKYGGFTKIKIAYYSIFEYTLDGKKGKQKITRIVPIPIYISQNIKDDKALLEYAQTRLPGKDLKIKYRKLCIGSLVKINNFNYYIGGKTNNNFTFDSAVQVILDKDSESYIKELAKYLNWKKENKDGKLWESITEDKNIQLYDSLVKKMNTGIFIRKTPNKYTELLTLEVKNKFINIDIDEQVKLLLEILNLLTNKKFTSKLNEIGITASRGVCSFNLSNQSQFSIIEQSVTGVYEKEKLIIEKKKEGIL

SEQ ID NO: 237 - protein, 1003 aa, Gluconacetobacter diazotrophicus
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALIPTPVGPDSYVIA

SEQ ID NO: 238 - protein, 1050 aa, Gluconacetobacter diazotrophicus
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 239 - protein, 1371 aa, Gordonibacter pamelaeae 7-10-1-b
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 240 - protein, 1054 aa, Haemophilus parainfluenzae ATCC 33392
MENKNLNYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDHKLERQEWAAVLLHLIKHRGYLSQRKNESKSENKELGALLSGVDNNHKLLQQATYRSPAELAVKKFEVEEGHIRNQQGAYTHTFSRLDLLAEMELLFSRQQHFGNPFASEKLLENLTALLMWQKPALSGEAILKMLGKCTFEDEYKAAKNTYSAERFVWITKLNNLRIQENGLERALNDNERLALMEQPYDKNRLFYSQVRSILKLSDEAIFKGLRYSGEDKKAIETKAVLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLKLKDLELMVNREREKDLYDTLKARLEAFNDDPAKAFAEPFIKKGGAIVKSVRVEQIQKSGVLVREGNGVADNASMVRVDVFTKGGKYFLVPIYTWQVAKGILPNKAATQYKDEEDWEVMDNSATFKFSLHPNDLVKLVTKKKTILGYFNGLNRATGNIDIKEHDLDKSKGKQGIFEGVGIKLALSFEKYQVDELGKNIRLCKPSKRQPVR

SEQ ID NO: 241 - protein, 1052 aa, Haemophilus sputorum CCUG 13788
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMIGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 242 - protein, 1052 aa, Haemophilus parainfluenzae
MENKNLHYILGLDLGIASVGWAVVEIDEKENPLRLIDVGVRTFERAETQKGESLALSRRSARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPALSGEDILKMLGKCTFEDEYKAAKNTYTAERFVWITKLNNLRIQENGLERALSDNERLMLIEQPYEKAKLTYAQVRSILNLSDDAIFKGVRYSGEDKKAIETKTTLMEMKAYHQIRKVLEGNNLKAEWVALKANPTLLDEIGTAFSLYKTDEDISAYLAGKLSQPVLNALLENLSFDKFIQLSLKALYKLLPLMQQGLRYDEACREIYGDHYGKKTEETHHFLPQIPADEIRNPVVLRTLTQARKVINGVVRLYGSPARIHIETGREVGKSYKDRHELKKRQEENRKQREKTISEIKTLFPNFSGEPKGKDILKMRLYYQQNAKCLYSGKPLELHRLFEQKYVEVDHALPLSRTWDDSFNNKVLVLANENQNKGNLTPFEWLDGKNNSERWRTFKALVETSAFPYAKKQRILSQKLDEKGFIERNLNDTRYVARFLCNFIADNMHLTGEGKRKVFASNGQITALLRRRWGLAKSREDNDRHHALDAVLVACSTVAMQQKITRFVRFKAGDVFTGERIDRETGEIIPLHFPTPWQFFKQEVEIRIFSDNPKLELENRLPDRPQANHEFVQPLFVSRMPTRKMTGQGHMETVKSAKRLNEGISMIKMPLTKLKLKDLELMVNREREKDLYDALKTRLEAFNDDPAKAFAEPFMKKGGAIVKSVRVEQVQKSGVLVRQGNGVADNASMVRVDVFTKDGKYFLVPIYTWQVAKGILPNKAVIQGKDEEDWEDIDDATFQFSLHPNDLISVKTKKDEFLGYFNGLNRHTGGINIRTHDLEKSKGKQGIFEGIGVKIALSFEKYQIDELGKNIRLCKPSKRQPVR

SEQ ID NO: 243 - protein, 1052 aa, Haemophilus sputorum HK 2154
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 244 - protein, 1338 aa, Helcococcus kunzii ATCC 51366
MQDYYLGLDIGTNSVGWAVTDENYNLLRKKGKDLWGVRLFKEAQPATERRGHRSSRRRTIRKSLRKQLLRELFEEEINAIDKDFFLRLDESKYWLEDKKIEGKYSLFNDENFTDKDYYEKFPTIFHLRKALIESDDKEDIRLYFLAINQMMKRRGHFLIDGKLSNVEDITPFKECIQNLINEELDTEIETEFYDKAIKIVSDYSLKKTEKKNLIKDLVKETDSIEDSKKIINIFNLLISGKSKVNGIFDDEEILEKIKEDNKEDFYLTSEKYEENLEYFSQLLDYRFELISSLKSIYDYIILQEVLKGKKYLSYAQVERYKNHKEDLRKLKQLIKKYDKNGKIYYQIFRDENFKKGYVAYLGYYKKNKKNVPVKKCDYDTFSKNIKSTLDKICDKEDPLYIELIDKIEKGGFLLKQIVSTNSVIPHQVHELELDKILENLEKNYPSFKEISDGVSKIDKIKMIFNFRIPYYVGPLNDYHKDKVNSNTWIVKNEGFENENIRPWNFSKIVDEHACEEEFIKRMINECSYIPGEKVLPKSSLLYSEYMVLNELNNLRVNGDKLNPKIKKEIVENIYKKERKVTLKKIRNFLIINNYVDSKVEFSGLSDGIKANMSSYIDFAEILDDNFDNNMVEDLIEQITIHVGNVKLLTEKISNKYPNLEKKQINKIVNLKFKDWARFSRKLLVGIEGTEKETGEINTIIGFLRETNENFMELMSNRYTFSEEISEIKKKYIPNKLSKQIVDDLYVSPAVKKMIWQVLNINDELIKVLGKQPKKIFIEMARGKEEKPEVKDSRKNKLIELYKNLGKEGKEWLNRIEDKTEADFRNRALYLYYTQMGRCMYTGEIIDIERLYDKELYDLDHIIPRKMKKDDSIHKNLVLVTRNSNQYEKKDNYPVPEVIKSRENVRHLWYALKKKGLITEEKYNRLTRINPLSDKELSEFIERQLVETRQTTKVVKDLFENYYTDSKIVTVKAGLVSELRRDFEVLKCREINDLNHAHDAFLNIIVGDVWSKKFTSNPYNFVKKNREKYTLNNIFTKNQKDLRGNEIWNCAEGKKRIIKTLNKPSVLFSVENFEQTGQLFDQNIIGKQDYKEKTSYVPIKGDERLQDISKYGGYRGISGAYFFIVEHTEKNKRVKTIESLPIYMKSYVEENGLLDFCTNEMKLVDPKIIVKKLNYKSEIIVDGFKYLISGKTENRLSLETNEYLYWNHTQTTDIKKILNINEKIELEKYNGDIESERENIIKYIQIILEKFKLKPFIKRRNLPNIEINFADYETEKLLQLLVNLIPLTTKYVSPVDLTVISGSKYAGKVLIPKKISNLNEVIFISKSITGIYESRRRII

SEQ ID NO: 245 - protein, 1007 aa, Helicobacter canadensis MIT 98-5491
MKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 246 - protein, 1023 aa, Helicobacter cinaedi CCUG 18818 = ATCC BAA-847
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFESKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 247 - protein, 1023 aa, Helicobacter cinaedi CCUG 18818
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 248 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRTPKDSLSAIEFIALSRTINTLINLSKESGEIYNRAIILQIVESTLKKGEISYKELREIIRLDERLRFKDPRLDYSREIKEAEKVKFLEFKQLKGFKKALGESFTTLARSQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNALLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRASVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDKNGVIKDWLEMDSSYEFIFSLYKDDLLLVQKKEMAEPELCYFMSFNSSIAQISVAKHDNNFSTLTKNQKLLFSNATQEDVSGKSIGIQNLQVFEKWQVSVLGEVKRTQSYPRENISLASKAKK

SEQ ID NO: 249 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 250 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 251 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 252 - protein, 1354 aa, Indibacter alkaliphilus LW1
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 253 - protein, 1397 aa, Joostella marina DSM 19592
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 254 - protein, 1060 aa, Kingella kingae PYKK081
MAAKSLNYILGLDLGIASCGWAVVEMDEQENPLRLIDVGVRTFEEAENPKDGSSLAETRRLARAQRRLISRRANRMNKLCRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 255 - protein, 1391 aa, Kordia algicida OT-1
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 256 - protein, 1314 aa, Lactobacillus animalis KCTC 3501
MLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 257 - protein, 1377 aa, Lactobacillus brevis subsp. gravesensis ATCC 27305
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 258 - protein, 1371 aa, Lactobacillus buchneri
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 259 - protein, 1371 aa, Lactobacillus buchneri
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 260 - protein, 1361 aa, Lactobacillus casei BL23
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 261 - protein, 1361 aa, Lactobacillus casei Lc-10
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGNTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 262 - protein, 1363 aa, Lactobacillus casei M36
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 263 - protein, 1361 aa, Lactobacillus casei group; identical to SEQ ID NO: 260

SEQ ID NO: 264 - protein, 1360 aa, Lactobacillus casei T71499
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 265 - protein, 1366 aa, Lactobacillus casei UCD174
MTKLGKPYGIGVDIGSNSIGFAAVDENSHLIRLKGKTVIGARLFEEGKAAAYRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAKEGDRDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQAVYYDWLAAPNPVEKHRQSMTYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGEFEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 266 - protein, 1389 aa, Lactobacillus casei
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 267 - protein, 1354 aa, Lactobacillus coryniformis subsp. coryniformis KCTC 3167
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 268 - protein, 1119 aa, Lactobacillus coryniformis subsp. torquens KCTC 3535
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 269 - protein, 1368 aa, Lactobacillus curvatus CRL 705
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 270 - protein, 1126 aa, Lactobacillus farciminis KCTC 3681
MADRISLGLDIGVASVGFSVLDIDKGKVIELGARLFSATVAAGNQDRRDMRGARRLLNRNKQRRQDTGKLFKKFGLIDDFDKGSFYDNFNQNLNPYELRVKGLTEQLTKEELAESLYQIVKHRGISYALKDADVDEGGTDYSVSLKINSQELAEKTPAQIQLQRLNDYGKVRGQVVIGDDPDNQKVLLNVFPTSAYEKEAKQIIATQQQFYPESLTDKFTEEYCQILTRKRDYFVGPGNEKSRTDYGIYKTDGRTLDNLFEELIGHDKIYPEELRASAASYTAQLFNVLNDLNNLRILNYEDGKLTKEDKEKIIAEIKNNTTTINMLNVIKKVAGCSKDDIKGFRVNEKDKPEISSMPVYRKIHKDLLKAGVDISDWPVEFIDELSFILTLNTENGEIRKQLNNRLAPKFDFLNADLIQLIIDNKDSFEIKTNNKWHRFSVKTMNKLIPEMMERPVEQMTLLNEMGLVKKDKKRFENNKYLPYKEIAKDIFNPVASKSVREALKIVNAVLKKYGHIDYLVVEMPRDKNLKEEQDNIKEFQNKNKKAKDAAFEAFVKSVGSEQRVKEALSKNRKLQMKMRLWYQQQEIDPYNGKTIDATDLINNPDKFEIDHIIPQSISFYDSINNKTLCFASMNQVKGQKTPYEFMLEGHGQSYDKFKATVMANKNFGKAKRANYLFEENVSDIETRKRFLSRNLVDTRYSSRVVLNSLQDFFREKSADTKVTVIRGKFTSNMRKHWHIDKTRETFHHHAIDASIIAATPFLRMWKKGGTIFPVKVGEESIDIETGEILDDKNFDKAMYEEPYSGFVSEIMNADDRIKFSHQVDKKMNRKVSDATIYSTRTGKLAKDKKDAEYIVAKVKDIYSVDGFKKFKKVYDKDKTKFLLYKYDPRTFSKLERIISDCPDKVEKVQTNGKVKAVDISPFEMYRRDHGMIKKYSKKGNGPAIKQLKYLDKKLGSHIDITPANANGKHVILQSLKPWRTDVYLNHETGEYEIMGIKYSDLKFNKNEGYGIKKDKYLEIKKVEEVSEKSEFMFSLYRKDRVKVQDMKTGESVELLFWSRNFSNKKYAELKPISQAENDKKLPVYGKGRLIKRLIPKNCKIWKVNTTILGDPYYLEKESDSPKDILD

SEQ ID NO: 271 - protein, 1356 aa, Lactobacillus farciminis KCTC 3681
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 272 - protein, 1313 aa, Lactobacillus fermentum 28-3-CHN
MHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIMKYRGHFLNNASVDKFKVGRIDFYKSFNVLNEAYEELQNGEGSFTIEPSKVEKIGQLLLDTKMRKLNRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKVSDVASLVMAKTRGVNKPSVEGLSDPKKFNSNLATYLDLKSIVGDKVDDNRYQTDLENIIEWRSVFEDGEIFADKLTEVEWLTDQQRSALVKKRYKGWGRLSKKLLTGIVDENGQRIIDLMWNTDQNFMQIVNQPVFKEQIDQLNQKAITNDGMTLREWVESVLDGAYTSPQNKKAIWQVVRVVEDIVKAVGNAPKSISIEFARNEGNKGEITRSRRTQLQKLFEDQAHELVKDTSLTEELEKAPDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKKRPVDLYGAYTNGTSAFMTIIKFTGNKPKYKVIGVPTTSAVGLKRVGKPGSESYNQELHRIIKSNPKVKKDFEIVVPHVSYSQLIVDDDCKFTLASDTYQHPATQLVLSKESMEIIADDFKFVKENTATADEQLVRVFDEIVNQMNHYFTIFDQRSNRQKVTKARDKFVSLPTESEYEGAKKTQVGKTEVITNLLMGLHANSAQGDLKVLGLSTFGFFQSSGGLNLSEDAMIVYQSPTGLFERRICLKDI

SEQ ID NO: 273 - protein, 1381 aa, Lactobacillus fermentum ATCC 14931
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 274 - protein, 1327 aa, Lactobacillus florum 2F
MTEQQQPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDPQFDDQKFHQQYPTIYHLRSALAQPDAPQADVRLIYLALHHMIKFRGHFLNGAAVEKFHGGQLHLESEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELEAQVTQEQRDGLKKAYDEYIDGDKPTIDTFYTNIKKNLDDSELANQIKSLIDLQAFMPKQRSKENGSIPHQLHQRELDQLIEVQGKYYPWLLAAKDKLDALIAFRVPYYVGPMIDPNQSDDPQNTKFAWMVRKEAGEITPWNFEEKVDKTSSATNFIKRMTTTDTYLLGEPVLPKNSLLYQQFTVLNELNKLKVNGKALTVDQKKYLYEHVCKKQRRVTLKKLSDCLMARGDFPMGAIFTGTTDQKNMNNTLKTYQDFQEIFGDEIDNPDRQVDFEKMIEWSAIFEDREIFKLKLAELNWLTSEQLERVSKKRYQGWGRLSQKLLTHIVNENGERIIDQLWNTNQNFMEIMGQDSVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQAENRVHKEDRLPGETVANKMRPTWKMMREQGLMTQRKYNNLTLKPDQISKFNNRGQFINRQLVETRQVIKLAADIMSQKYQADQTKVVTVKANLTHHMREKFNFYKSRNVNDYHHAFDAYLTLFVGNWLLKEYPKLQPYFVYGDFAKTGTNNLKSFNFLYRFERDHKLNDKGAIDTDKDQQLGYMKRIYRFKKMLVTKQLETNEGALYGQTLYPAPKNDKKTRNLINSKKNRPSDIYGGYSNENGSFLTLVKLKKGSKYDYRLVAVPVSKISEIKESELATIEKAIAPQFLKSSGKYRDFQVVLSKILINQKVIDDGMIFTIGSKSYKHNAKQVVLSDNSIQIVSTLSRISDKEKLITVFDEIVDITSKYLPWYKVNDVEKTKMLFRQMQDIDEMKKIIDNSLIGLHCNASITDLGKVGLSKYWGRFVLTAGISLTVDAQLIYQSPTGLFEHRVKVSDL

SEQ ID NO: 275 - protein, 1391 aa, Lactobacillus gasseri JV-V03
MTKIKNEYIVGLDVGTNSCGWVAMDFQNTILRMHGKTAIGSHLFDAGNSAADRRAFRTTRRRIKRRKWRLKLLEEIFDPYMTEVDPYFFARLKESGLSPLDKRKNVSSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKKVFKINKVKSIHQLLSLKTENKERTKLIKDVSKQIINAILGYKTKFETILLKNISKDEADDWEFKLTDVDADNKFENLIGDLNENEQEILLEIRNLANAITLSNIVEEGKTLSESMIDKYNKHSDDLELLKQVISDHPDRDKAKKLALAYDLYVNNRHGKLLQAKDVLGSKKTLSKEDFYKEVKKNLDDSKASQEILDTIALDSFMPKQRTNENGVIPYQLHQLELDRIIKNQGKYYPFLKEVNPVSSHLKEAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKEELYNNLFKKNSTVTTNKLKSYLKENYNLINVEIKGLADEKKFNSGLTTYNKLRNLKIFDQQLDDLNYDKDFERIIEWSTIFEDKAIYKDKLKTIKWLSDRQIDKLSKIRMQGWGQLSKKLLSQLTDNNGQTIIEQLWDSQNNFMQIVNQSDFKDAIAVANQNLLVNTSVEDILNEAYTSPANKKAIRQVVKVVDDIVKAASGKVPKQIAIEFTRDADDKAKISQTRANKLRKVYKELSNELASETIRNELERVAKDQKLLKDKYYLYFMQLGRDAYTGEPINIDDLGQYDIDHILPQSFIKDDSLENRVLVKKAVNNGKSDNVPVKLYGNRMAADLGMTIRHMWEKWKDQGLITKTKYNNLIIDPDKINKYESSGFIHRQLVETSQIIKLVSTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKSNDIISLETKKKVFDKKDIIEKLKHAYNYKYMLVSRETETHDQEMFKMTVYPRLSRDTKKSRNLISKKKDMPTEIYGGYTNNSDAYMVIARINKKKGTEYRVFGVPMRELVNLRKAEKNGRYNAYLKQVLEPEIMYSKNGKKNKTISSFEIVKAKVPYKQVILDGDKKFMLASSTYVQNAKQLTLSQNSMQAITDNCENDTEEEKALEEKALIEAYDEILTNIDKYLPLFDINKFREKLHAGREKFINLSLDVKKDTILQVLNGLHDNAVMPKIKSLGLSTPLGFMQFSSGVPLSENAKLIYQSPTGLFEKRVKISDL

SEQ ID NO: 276 - protein, 1386 aa, Lactobacillus hominis CRBIP 24.179
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 277 - protein, 1369 aa, Lactobacillus iners LactinV 11V1-d
MNNNYYLGLDLGTNSVGWAVTDDHYNIIKFHGKHMWGMRLFEEAETAKDRRLHRQARRRRQRLVERINLLEELFDKEISKVDQGFFARKKESDLHFEDKTTKSEYALFNDKSYTDRDYYKQYPTIFHLIMDLIENDKKRDIRLVYLACHYLIKHRGHFIFDGKNFTVDNSFENLLDKLITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKILDNQSKYYDFLLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKVDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 278 - protein, 1391 aa, Lactobacillus jensenii 269-3
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 279 - protein, 1395 aa, Lactobacillus jensenii 27-2-CHN
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 280 - protein, 1375 aa, Lactobacillus johnsonii
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 281 - protein, 1382 aa, Lactobacillus mucosae LM1
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 282 - protein, 1362 aa, Lactobacillus paracasei subsp. paracasei 8700:2
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 283 - protein, 1382 aa, Lactobacillus pentosus IG1
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 284 - protein, 1361 aa, Lactobacillus pentosus KCA1
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 285 - protein, 1358 aa, Lactobacillus pentosus MP-10
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKIGFGKLQVPGGLKLTDQAEIIYQSPTGLFERKVALKDL

SEQ ID NO: 286 - protein, 1358 aa, Lactobacillus plantarum
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 287 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 288 - protein, 1361 aa, Lactobacillus rhamnosus HN001
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQEHYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 289 - protein, 1361 aa, Lactobacillus rhamnosus R0011
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 290 - protein, 1375 aa, Lactobacillus ruminis ATCC 25644
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 291 - protein, 1339 aa, Lactobacillus salivarius SMXD51
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 292 - protein, 1331 aa, Lactobacillus sanfranciscensis
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 293 - protein, 1419 aa, Lactobacillus sp. 66c
MAKPQNYTIGLDIGTNSVGWTVTDDQNNILRIKSKKAIGARLFEEGKVAAERRSFRTTRRRLSRRKWRIKLLEELFDEEISKVDPNFFARSHESWISPKDKRERYSAIVFPTPEEDKKFHNEYPTIYHLRDRLMKDDQKHDIREIYVAIHHIMKYRGNFLHDESIETYRSGMSSLGGGDERTILNTKILDDLNDAFADNLATQGISVNSASADQINEIVTSGHLNVDSQKAIAKLLLPTTLSSDDKKQDKKIKKLATDAAKNVASAWLGYKANFAAILNIQEVDKDKKKIYSFALQGADEEDKVETLESVLSQDQIEIVDRIIRIRHAIVLGEIIPVGMTLSEAMIEKYDQHAKDLKNLKTVIRNLKDRKNAVKLQAIYDLYVNNRHADTAKAMKLAGVKKRTELLEPEEFNKSIEKLLDDSPVSAEIKKRIAEKDFLPLQRSNSNGVIPNQLHQIELDEIIKKQSKYYPFLGETNEHASADVARKAPTKLDQLLTFRVPYYVGPLITKEEQEEQDGHSFAWMIRKNPKDHEKITPWNFDEKVDRMASATQFIKRMTTKDTYLLGEDVLPSSSLKYQLFTVLNELNNLRINHKKLTREEKEQVIEDLFKKYKTVKADKFKNYWQKGHAGLDVKIQGMADPEKFNSTMSTYIDLQKIFGDQLDDAQRQNDFEKIIEYSTIFEDRKILGEKLRADFVWLSEDQIKRLCRLRLQGWGRLSLKLLTRLTDADGQNVLERLLNSNDNFMQIVKDPVIKAKIEQKNQKLLRADWSENATESILDEAYTSPQNKKAIRQVMRVVHDIVKACDGNLPAKFAIEFARSQDDDPKRTVARADRLQKIYAQISDEVVSQGVKDQLSGMKSLKDRYYLYFMQGGRDAYTGKPLNIDRLSDYDIDHIMPQSFIKDDSLDNRVLVTRAVNNQKSDNVPVLLYGNHLVADLGITIREMWDRWQKSGMISKRKLANLLTDPATLSEYRAEGFINRQLVETSQVIKLTATILQSEFPDSKIIEVPAKYNSILRKQFDLYKSREVNDYHHAIDAYLSTIVGNYLYQVYPNLRRLFVYGEFKKFSHGEEESSHQAVRRVKSMNFLDDLLRGKHGDDIYCRVTGEVIFSRKDIISKLKQAYSFKQMLVTQEVFTKKSALFDQTVYPSPARDSKTRSGLIPRKQGMDTEIYGGYSGNKDAYFVLAQVVKSKGHTLQVVGVPIRALRALANCSNYSEQLLKIVKAQVLFNKKTGKAKKGISDVRILLDKIPYRQPVLDGSAFYMLGSSTYKYNLKQISLSQQSMKYILDYIDDPNFNKHEMTKIDQQNEKECLLSVYDEILDKMDKYLSLYDINGFRKKLHVGRDKFIKLEVEKQAEAIKNVLRGFHANSDMTKLSDLGLSTSLGFMQASDGIKLSDNAVFIYQSPTGLFERRVKVSDLLK

SEQ ID NO: 294 - protein, 1289 aa, Lactobacillus versmoldensis KCTC 3814
MRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 295 - protein, 1372 aa, Legionella pneumophila 130b
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKNFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGGSSDKTLEQAIEKQNIQWEEKFQRIINASMNICPYKGASIGGQGEIDHIYPRSLSKKHFGVIFNSEANLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 296 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 297 - protein, 1355 aa, Leuconostoc gelidum KCTC 3527
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 298 - protein, 1337 aa, Listeria innocua ATCC 33091
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 299 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 300 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 301 - protein, 1334 aa, Listeria monocytogenes FSL J1-194
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 302 - protein, 1334 aa, Listeria monocytogenes FSL J1-208
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 303 - protein, 1334 aa, Listeria monocytogenes FSL N3-165
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 304 - protein, 1334 aa, Listeria monocytogenes FSL R2-503
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 305 - protein, 1334 aa, Listeria monocytogenes serotype 1/2a str. F6854
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 306 - protein, 1087 aa, Listeriaceae bacterium TTU M1-001
MKKLVLGLDIGVASVGWGIIDAENGDVVDTGVRLFSSRDASENESRRTSRQSRRLSRRKKHRRERIKQLLLAHDMDICDIVNENPYELRVKGLNEKLEVSEIYVALTHLAKRRGVSYLDDVVEEGGTIKSEHLNKNMEEIKSGKMPCEIQLERFEKYGQVRGMIEINQDTEESSFLVNIFRTSDYIKEAKTILATQQKFHKQITNEFIDEYIHIMASKRDYFIGPGNEKSRTDYGVYRTNGDTWDNLFEILIGKCSVFPEETRAARSSYVAQEFNLLNDLNNLKISNLESGKLSASQKHDIVEKVKNSKKFGTKDLLKYIASVCECKIEDIGGCRVDKNRKPIMHTFENYRKVHNALNEAGVDLRLSETDYDELMKIMTLNSETLEIKKQCKEKLPQLTEDYLNVCLVLNKKGAFSGWHALSLKAMKLMMPELYGTSKNQMQIIHTMQLGKAYLKPLNQQKYLNSEAILEEIYNPIAARSIRQTIKVTNAILKKYGHLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWRIFKDRNESHSHHAIDALIVAATANLRLWKKNTLGVSDEGKVYDKETGEILPFEKLTESEYNEMMNKEPYLNFKTKLQNIETKVKYSYRVSKKVNRKISDATIYSTRERDGIDYIVGKIKNIYDVKTYKDQFLKRYKKNKEQFLMYQHDPQTFAILENIMATYQDAENPFLAYKKEYGVIRKYSKKGGGSPVTSLKFIDKVLGQKIDLTAKNQAALPKNKKVVLQSITPYRADVYYDEIDKRYHLIGVKYSLFSFSKQGYVINPIAYQKLLEKEQIHSEMKFCFSLYREDIIEFGEDPDSLTRYRFWSKNESGKNKIEVKPIEKPNFEKQTVLTITKKIKILNKYQTDVLGNSFKAQEEKDPRNIE

SEQ ID NO: 307 - protein, 1345 aa, Marinilabilia sp. AK2
MKKILGLDLGTTSIGWAFIKEPEKDVVGSEIVDMGVRIVALSSDEENDFAKGNTISINADRTLKRGARRNLQRFKLRRDALLEIFKEMKLIPSNFKYAEDGPSSTFSTLKLRDKAAKEKIELDDLVKVLLQINKKRGYRSSRKAKSEEDDGSAIDSMGIAKELYENDLTPGQWVFEALQKGRKNVPDFYRSDLQEEFKKIVNYQSEFYPDVLNSSFVEDWMGKASTPTKQYFNKKGVHLAENKGKREERRLQEYNWRAVAVNSKIDLSEIALILSQINSQISNSSGYLGAISDRSKELYFKNQTVGQYLYQQIKINPHTRLKGQVFYRQDYLDEFEKIWSVQSGFHPQLNDALKKEIRDITIFFQRRLKSQKHLISNCEFEDYHKVVPKSHPIFQEFRIWQNLNNLTLIKKDNLNEKSELALEDKIALANELAFKREQSVKDALNILGLKSSEWEFNFTKIEGNRTNHAFFEAFAKIIEIEDGEPLDLGNLKADDILDQFSEAFLRIGIDPGLLQVNNDIEGPNYEKQPYIQFWHLLYSSEDDQKLKQNLIKKFGFKPDHAKILASISLQDDHASLSSRAIKKILPHLQSGLIYDKACTYAGYNHSSSFTKEENEKRELSSELDLLKKNSLRNPVVEKILNQMINVVNAILKDPNLGKPDEIRVEMARELKANAEQRKNMTSNIASATRDHEKYREILKKEFGLKRVTKNDLLRYKLWLETDGISLYTGKPIEASKLFSKEYDIEHIIPKTRLFDDSFSNKTICERQLNIDKANVTAFSFLQNKLSGDEFEQYQSRVKSLFGKLSKAKIQKLLMANDKIPEDFIARQLQETRYISKKAKEILFEITRRVSVTTGTITDKLREDWGLVEIMKELNWEKYDKLGLTYTIEGKHGERLNKIKDWSKRNDHRHHAMDALTVALTKPAYIQYLNNLNAKELNGKKSTEIFAIEQKYLKRENGKLCFIPPVENIRTEAKKHLSKVLISYKAKNKVVTINKNRTNKKAGFNEQIALTPRGQLHKETVYGKAFHYSTKFEKIGASFDVQKINAVAKKEEREALLKRLAENGDDPKKAFTGKNSLSKMPIYLDLKRNIKLPEKVKTVVLEQNYTIRKNIDPDLKLDKVIDVGVKRILENRLKEFGGNAKLALSNLDENPIWLNKEKGITIKRVKISGVSNVESLHVKKDHFGEPILDQVGNEIPVDFVSTGNNHHVAIYEDEKGNLQEEVVSFFEAVVRQNQGLPIINKNHSLGWKFLFTLKQNEYFVFPSDDFDPTDVDLMDEENYHLISPNLFRVQKFTTKDYFFRHHLETTVEDKSELKGVSFKRLGLPGLNCIKKIRINHLGKIIQVGEY

SEQ ID NO: 308 - protein, 1352 aa, Megasphaera sp. UPII 135-E
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 309 - protein, 1080 aa, Methylocystis sp. ATCC 49242
MRVLGLDGGIASIGWALIEIFEDHEPSDGRIIDTGAWMFDAPEEKSQTGTKLKSELRRIFRGQRRVIRRRRQRMNEVRRILHRHGLLSSDNRDALKQPGLDPWKIRAEGIDRLLSPIEFAVALGHIARHRGFKSNSKGAKTSDLDAESSRMKKAVGETREKLARFGSPAKLLVEDEGFVLRQTKLKSGALETVRRFRNRDGDYSRSLLRDDLAAEVRALFRAQARLQSTFAKVELEAEFTQAAFFQRPLQDSERLVGPCPFEPAEKRSPKRGYSFELFRFLSRLNHLTLREGSEERTLTVEELRTAAADFGGVAKFTFSTLRKRLALPDIAIFVGIKADDEKKLDVVARSGEAATGTARLRRVVIDALGELAWGALISAPERLDKITEIITFRSDLDRIRAGLIEAGFDTPLIEAIVRAAADGKLDAFTGVGHISAKAARNIIPGLMRGMTYDKACAAAGYDHTASRERDAFDVGMHGKEALKKILQEERISRELVGSPSARKALIEAVKQVKAIIEKYGVPDRIHVELARDVGKSIEERRDIHFGIEKRSRQKDKLRELFGKEVGHLPQDGERGKEELLRFELWNEQMGRCLYTDEYINPKQLVASDNSVQVDHILPWSRFGDDSYLNKTLCTAKANQDKKGRTPYEWFRADKPEAEWDAFVARVESIQFMKGLKKRNYKLKNAEEAAEKFRSRNLNDTRWTCRLLAEALKQLYPKGEKDKDGKERRRVFTRPGALTNRLRRAWSLQRRKKSEKGERIADDRHHALDAIIVAATTESLLIRATREVQDIERKGLHYDLTKNITQPWPGFADEALDAVEKVFVARAERRRARGKAHDATIRHIAVRDDEAKVYERKKVGDIKLGDLIRVKDAERNAPLIENLRKWIEAGSPRDNPPLSPKGDPVSKVRLVTKNKVNITLDTGNPERLATVDRGEMARVDVFRKANRKGKYEYYLVPIYPHEIATMETPPMRAVQGGGDDDKWPEIDSTFEFLWSINQLSLLELTKPDGEVIRSYFRSLDRNTGALTVSGIANSTATRKGIGTRTLIDFKKLHVDRLGQIFEVERELRTWRGETWRGKDCI

SEQ ID NO: 310 - protein, 1082 aa, Methylosinus trichosporium OB3b
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 311 - protein, 1123 aa, Mobiluncus curtisii subsp. holmesii ATCC 35242
MFVYLNSPRGFGPATFLTDLPHFCIIFGNNDFMDNRKYHVGIDVGTNSVGFAAVEVGDSGSPIRFLNTMVVIHDSGVDPEQKKYAITRLASAGTARRTRRLYRTRRQRLRELDDFISNELGYPLVNLENFADPYEPWKVRADLATIKLPADELPEAMSIALRHMARHRGWRSPYQRVEALHLHAEISEEFSALKKRVMEKTGDVFSDDATPAEVLVDLMGRQKIRGADGMLSGKLRQSDNANELRKIASVQGIDDETLNRIIDRVFFSRSPKGKASERVGMDALPGQGSKPRALKAMPSFQKFRIVSVICNLRIKDSGDDNRPLSMEEKEQLIGYLMSSTTDDHVTWTDVAELLHVKRSNLQGTAKEGPDGERPYTRPPVNSAWSKIKDSKIKSLVALWKTGDVDVQSAIVEALSNASVLEDARPGADIVVAYLESLDDKELESLDKVGLPAGRASYSEDSLERLTERMLQDDCDLFEARKREFGVSDDWKPPADPIYAPVGNPGVDRVLKIVNRLLMAAEREWGAPTQINIEHVRSGFSSELMQREFERENERRRAQNEEAVKAILTEKGGNSHVSKYDIIRYYAVKRQNCQCLYCGTPITFSDCELDHIVPRKGVGSTNSRVNLAAACRSCNRDKSNLPFAVWAGKTSNFDVSIDGAVSRVKQWQRSQNEGAREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETAREHFAVWKSNMERLTDLFNDKLENDAIPVVQPLRLRLSDSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKIFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILSGQGWRPAINVLFSKGKPRIVRRNSLGIERPSSNNGLPFSWEA

SEQ ID NO: 312 - protein, 1091 aa, Mobiluncus mulieris 28-1
MDSRKYRVGIDVGTNSVGFAAVEEDDSGSPTRFLNTMVVIHDSGVDPEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 313 - protein, 1091 aa, Mobiluncus mulieris FB024-16
MDSRKYRVGIDVGTNSVGFAAVEEDDSGSPTRFLNTMVVIHDSGVDSEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 314 - protein, 1473 aa, Mucilaginibacter paludis DSM 18603
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 315 - protein, 1233 aa, Mycoplasma canis PG 14
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 316 - protein, 1233 aa, Mycoplasma canis PG 14; identical to SEQ ID NO: 315

SEQ ID NO: 317 - protein, 1233 aa, Mycoplasma canis UF31
MEKKRKVTLGFDLGIASIGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTNANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNELLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISTNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNPDTSKTPKRLMFGIKSIMNNYEQVDISPFGINKKIFE

SEQ ID NO: 318 - protein, 1233 aa, Mycoplasma canis UF33
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEENAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKSHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGMAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDKFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 319 - protein, 1233 aa, Mycoplasma canis UFG1
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMLSVEDIDMIKYEWAGKEPNVYGVGLSGLNIEESAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFDDKYEKLIYKIFLWISQDFKDPYTGAKISANEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 320 - protein, 1233 aa, Mycoplasma canis UFG4
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTIESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTSANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDAILPKLLDNNEGWNLEAIKNYDEEIKSQIEDNSFLMAKQDKKYLNDNFLKDAILPPNVKVTFQQAILIFNKIIQKFSKDFEIDKVVIELAREMTQDQENDALKGIAKAQKSKKSLVEERLEANNIDKSVFNEKYEKLIYKIFLWISQDFKDPYTGAKISANEIVDNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDDKKMFKVIAMNGAVTSFIRKNMSYDNKLRLKNRNDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKLSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 321 - protein, 1239 aa, Mycoplasma cynos
MEEKRKVTLGFDLGVASVGWAIVDSETNEVYKLGSRLFDIPDTNIDRRAKRGSRRLVRRRSYRNQKFYNLIKRTKTFGFLDKEAIEKEFVLLSIKYPNIIELKVKGLQEEVSKSEAVWILHDYLKNRGYFYDDKEEKDDLENPSIESMPSYKLYEFYKEYGYFKGALSSPTESEKNKDSDLEKAIFFNFSNKEWTKEINHFFKIQKNIFSEDFKAKFMEFFSFIRDISKGPGSENMPSQYSIFGKYGDDGMGGKYQHIWDKNIGKCSIFKDKVRAPKYLPSALFFNLLNELSNIRLYSVDKREKSVLWRLSSKDKINIILNILQIILFKNDGKISNLDINKIVKNESIKSIILNEIDLDLIKDMWFEKEPNVYGIGLSGLNIEENKKENRFKFQDLKIFSVFIDLLKKSNINIEFNNEKDIIHNLKLLDELYFFLITQKYSRDKYGSIKKFILNNKSFNIDNLDEKLNIFLSISDDEFDNHNSKTHSLSKEAIYFIFPKLLHNNEGWNLEAIKNYDIDVREEISKHSFGIKKQDKKYLDDAFLDDAILPPSVKVTIKQSILIFNKIIKKFSNKFQIDNVVIELAREMTQEKEMDAQKSLNRLKKSRKKIIEERLNANNIDSKMFRDKTGEISPNYIYKIYLWISQNFKDPYTGENISANDILKNNVEIDHIIPYSLCFDDSSSNKVLVFKHSNQSKGNFLPFDMISTFSENSVWNWKEYTQYVEKTFKTNLESILDKKERVKKADNLLTSSYDGYDKLGFLARNLNDTRYATILFRDQLINYSENHLIDSKKMFKVIAMNGGVTSFIRKNMSFDSGLKVKDRSIFSHHAYDAAIIALFSNKTKILYNLINPSLDGIISKRSEGYWVLEDRLTGEIRKLNYNDWQSIKNNVEVKKIAREIESHLSNLDNVVMFSRKSKRKTNKELYNETLYGIATRIDENGIKNYYKKEKFNILEDENIYLRLLNERENFIINRSNPEVIDAIIEIFETIDKNKIPARDVAKNIKYTDNKIKYNLYLKDYMRKLVDEFPDKFRKDFIEQMIAKKIFILFNPIKNTTRKIKSLRSINNNKIEDIRKKQVLEKFNTAKNEPRSFYESLNSLGAIIFKNNLNIYKKMSISSQIATFGDKNWKIDDINTYNKEKLNKYKEIYGIDETYDFYSFIFPGTILLDEKNKEFLYISSIQTLKDKIELKFLDRIEFEKKNVNSNLKPKIKREIISTKKLMSDYKIIKISPLGINKKIFE

SEQ ID NO: 322 - protein, 1269 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 323 - protein, 1224 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKRRKQIGS

SEQ ID NO: 324 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 325 - protein, 1269 aa, Mycoplasma gallisepticum str. F; identical to SEQ ID NO: 324

SEQ ID NO: 326 - protein, 1270 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 327 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 328 - protein, 1265 aa, Mycoplasma ovipneumoniae SC01
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 329 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 330 - protein, 1304 aa, Mycoplasma synoviae 53
MLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 331 - protein, 1401 aa, Myroides injenensis M09-0166
MKRILGLDLGTTSIGWAYVHEAENVNETSSIQKVGVRVNPLTTEEQTNFEKGKPITTNASRTLARSARRNLQRYKLRRDNLIQILKENNWINNTTSLTETGNHSTFETYELRNKAASEKLTLDQLSRVLLMLNKKRGYKSSRKVNSKEEGQLIDGMEVAKKLYHEQLTPGQLSLQLMNQGVKKLPDYYRSDLNQELESIWNFQQQFYPNILTDKFKEEINGKGLTSTSSAFWNIYNFNTAENKGSRDEKKKQALQWRSEALSKQLSKEIVAYIIADLNGQIYNSSGYLGAISDRSKELYFNNLTVGQYLFKQLKSNPHTSLKNQVFYRQDYLNEFEKIWETQSKFYPKELTAALKREIRDVIIFYQRKLKSQKGLISFCEFEQKQKTINGKTKTIGHRVIPKSSPLFQEFKIWQQLHNVVLRNKKTNEIVSLADEQKVHLFEELNLKGKLKSNQVLKLIENKPKDWELNYTELEGNNTNKALYNAYLDILDIEGYDVRNELKVKLNKDDIELSDLDVNASEIKEMIFSVFKHLGINTEILEFDATLEDKVFEKQASYQLWHLLYSYEEDNSPTGLDRLYNLLHKKFGFKLNHAKLIGNVLFQDDYGSLSSKAIKNIFPYITENNYYTACELAGYKHSKHSLTKEENETRELKNRLTILPKNSLRNPVVEKIINQMINVVNTLIDEENNILIAQGKEPNFQFDEIRIELARELKKNAKEREELTKSINKSKTDHEKIIKILQKEDGIKNPTRNDIVRFKLYSELKNNGYKDLYTNEYIERKDIFTKEYDIEHIIPQSKLFDDSFSNKTLVRRNVNLKKGNQTAYDFILCEYGQEKANEFETRITNLYNLGKDEGISKSKFKKLLMQESEIGNGFIERDLRETQYIAKKAKSLLLEITRNVISTSGSITDRLREDWGLINVMKELNLQKYRDAGLTEFVKMKDGNKKEVIIDWTKRNDHRHHAMDALTIAFTKHNHIQYLNHLNARKNVNNELHNNIIAIEKLETTLVSDERGNKKRIFKEPIANFRTIAKSHLEAILVSHKAKNKVVTKNINKISGKKISQQTLTPRGQLHKETIYGKIRQYVSKQEKVGPKFTIEVIEQVSNPTYRNLLLKRLEENNNDPKKAFGGKNSLNKNPIYINLEKNIKVPEVLKLVWLEDNYTIRKEISPDLKIDKVIDQGVKQILQNRLAQYKGDSKLAFSNLDANPIWLNEDKGIAIKRVTISGIATAQPLHRKKDHLGQPILDHNGQEIPVDFISTGNNHHVAIYEDENGKLQESVVSHFEAVERVNQKLPIIDKTFNQHLGWKFLFTMKQNELFLFPSDDFNPNEIDLFDKQNYTVISKHLFRIQKLSTKDYSFRHHLETNVEEIKDLKTITWRREGLNGIQNIIKVRTNHLGEIIHIGEY

SEQ ID NO: 332 - protein, 1466 aa, Myroides odoratus DSM 2801
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 333 - protein, 1077 aa, Neisseria bacilliformis ATCC BAA-1200
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 334 - protein, 1082 aa, Neisseria cinerea ATCC 14685
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 335 - protein, 1081 aa, Neisseria flavescens SK114
MTAFKPNPINYILGLDIGIASVGWAMVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELAVNKFEKESGHIRNQRGDYSHTFSRKDLQAELVLLFEKQKEFGNPHISDGLKEGIETLLMAQRPALSGDAVQKMLGYCTFEPTEPKAAKNTYTAERFIWLTKLNNLRILEQGSERPLTDTERATLIDMPYKNKLTYAKARELLGLDDTAFFKGLRYGKDNAESATLMEMKAYHAIRRALEKEGLKDKKSPLSLSPELQDEIGTAFSLFKTDEDITGRLKGCLQPEILDALLKHINFDKFVQISLKALRRIVPLMEQGKRYDEACAETYGDHYGEKNSEEMLYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKAIDIRRLNGKGYVEIDHALPFSRTWDDSFNNKVLVLGSENQNKGNRTPYEYLNGKDNSREWLEFKARVETSRFPHSKKQRVLLQKFDEKGFKERNLNDTRYVNRFLCQFVADHMQLTGKGKRRVFASNGQITNLLRGFWGLHKVRAENDRHHALDAVVVACSTVAMQQKITCFVRYKEMNAFDGKTVDKETGEVLHQKTHFPQPWEFFAQEVMIRVFGKPDGKPEFEEADTPEKLRALLAEKLSSRPEAVHEYVTPLFVSRAPNRKMSGAHKDTLRSAKRFVKHNEKISVKRVWLTEIKLADLENMVNYKNGREIELYEALKARLGAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLMQKYQIDELGKEIRPCRLKKRPPVR

SEQ ID NO: 336 - protein, 1082 aa, Neisseria lactamica
MAAFKPNPMNYILGLDIGIASVGWAMVEIDKEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFSNPHVSDSLKEGIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEAPTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDNPAKAFAEPFYKYDKAGNRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 337 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 338 - protein, 1082 aa, Neisseria meningitidis 2007056
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKKRPPVR

SEQ ID NO: 339 - protein, 1082 aa, Neisseria meningitidis 63049
MAAFKPNPINYILGLDIGIASVGWAMVEIDEEENPIRLIDLSVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFVWLTKLNNLRILEQGSERPLTDTERATLMDEPYRKSKLTYAQARKLLGLEDTAFFKGLRYGKDNAEASTLMEMKAYHAISRALEKEGLKDKKSPLRLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 340 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 341 - protein, 1082 aa, Neisseria meningitidis 92045
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGGKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 342 - protein, 1081 aa, Neisseria meningitidis 93003
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEEIYLPPITADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKENSREWQEFKARVETSRFPRSKKQRILLQKFDEDGFKERNLNDTRYVNRFLCQFVADRMRLTGKGKKRVFASNGQITNLLRGFWGLHKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKDLEKMVNRAREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 343 - protein, 1081 aa, Neisseria meningitidis 93004
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAKLALNKFEKESGHIRNQRGDYSHTFSRKDLQAELNLLFEKQKEFGNPHISDGLKEGIETLLMTQRPALSGDAVQKMLGHCTFEPTEPKAAKNTYTAERFVWLTKLNNLRILEQGSEQPLTDTQRAKLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYNEACAEIYGDHYGKKNTEEKIYLPPIPADEIRNPVVLRALSQARKVINGVVRRYGSPARIHIETAREVGKSFKDRKEIEKRQEENRKDREKAAAKFQEYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 344 - protein, 1082 aa, Neisseria meningitidis 96023
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLYQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 345 - protein, 1081 aa, Neisseria meningitidis 98008
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 346 - protein, 1082 aa, Neisseria meningitidis
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 347 - protein, 1082 aa, Neisseria meningitidis alpha275
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 348 - protein, 1082 aa, Neisseria meningitidis ATCC 13091
MAAFKPNPINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPTEPKAAKNTYTTERFIWLTKLNNLRILEQGSERPLTDTERATLMDEPYRKSKLTYAQARKLLELDDIAFFKGLRYGKDNAEASTLMEMKAYHAISRALEKEGLKDKKSPLNLSPELQDEIGTAFSLFKTDEDITGRLKDRIQPEILEALLKHINFDKFVQISLKALRRIVPLMEQGKRYDEACAEIYGDHYGKKNTEEKIDLPPIPADEIHNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLTEKLSSRPEAVHEYVTPLFVSRAPNRKMSGQGHMETVKSAKRLDEGISVLRVPLTQLKLKDLEKMVNREREPKLYEALKARLEAHKDDPAKAFAEPFYKYDKAGNRTQQVKAMRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 349 - protein, 1081 aa, Neisseria meningitidis N1568
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLSLEDTAFFKGLRYGKDNAEASTLMEMKAYHTISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 350 - protein, 1081 aa, Neisseria meningitidis NM140
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVADNAHALQTGDFRTPAELALNKFEKESGHIRNRRGDYSHTFSRKDLQAELDLLFEKQKEFGNPHISDDLKEGIETLLMTQRPALSGDAVQKMLGHCTFEPTEPKAAKNTYTAERFVWLTKLNNLRILEQGSERPLTDTERATLMDEPYRKSKLTYAQARKLLELDDTAFFKGLRYGKDNAEASTLMEMKAYHAISRALEKEGLKDKKSPLNLSPELQDEIGTAFSLFKTDEDITGRLKDRVQPEILEVLLKHISFDKFVQISLKALRRIVPLMEQGKRYDEACAEIYGDHDGKKNTEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENNRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 351 - protein, 1082 aa, Neisseria meningitidis NM220
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 352 - protein, 1082 aa, Neisseria meningitidis NM233
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADKIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 353 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 354 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 355 - protein, 1089 aa, Neisseria sp. oral taxon 014 str. F0314
MTAFKPNPLNYILGLDIGIASVGWAMVEIDDKENPVRLIDLGVRVFERAEMPKTGDSLAAARRLARSVRRLTRRRAHRLLRARRLLKHEGVLKPEDFDENGLVKPLPYIPKQPRNTPWQLRAAALDRKLTPLEWAAVLLHLVKHRGYLSQRKNEGETDDKELGALLKGVADNTHALQAGNFRTPAELALNKFEKESGHIRNQRGDYSHTFSRKDLQAELVLLFEKQKEFGNPYVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSLSPELQDEIGTAFSLFKTDEEITGRLKGCLQPEILDALLKHISFDKFVQISLKALRRIVPLMEQGKRYDEACAEIYGDHHGRRNSEETLYLPPIPADEIRNPVVLRALSQARKVINGVGRRYGSPARIHIETAREVGKSFKDRKEIEKRQEENRKDREKAAAEFQEYFPNFVGEPKSKDILKLRLYRQQNCKCLYSGKEINLGRLNEKGYVEIDHALPFSRTWDDSFNNKVLVLGSENQNKGNRTPYEYLNGKDNSREWQEFKARVETSRFPHSKKQRILLQKFDEEGFKERNLNDTRYVNRFLCKFVADHMQLTGKGKRRVFASNGQITNLLRGFWGLRKVRAENDRHHALDAVVVACSTVAMQQRITRFVRYKEMNAFDGKTVDKETGEVLHQKTHFPQPWEFFAQEVMIRVFGKPDGKPELEEADTPEKLRALLAEKLSSRPEAVHEYVAPLFVSRAPNRKMSGQGHMETIKSPKRLDEGISVVRVPLTQLKLKDLEKMVNREREPKLYEALKARLEAHKDDPAKAFAEPFYKQDKAGNRTQQVKAVRIEQVQKTGVWVRNQNGIADNATMVRVDVFEKGGKYYLVPIYSWQVAKGILPDKAIIAFKDEEEWQLIDDSFNFKFPLHPNDLVEVITKKARIFGYFASCHRGTGNINIRIHDLDNKVGKNGILEGIGVKTALSFQKYQIDELGKEIRPCRLKKRPPVR

SEQ ID NO: 356 - protein, 1097 aa, Neisseria wadsworthii 9715
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 357 - protein, 1426 aa, Niabella soli DSM 19437
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 358 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 359 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 360 - protein, 1044 aa, Nitrosomonas sp. AL212
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 361 - protein, 1498 aa, Odoribacter laneus YIT 12061
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 362 - protein, 1389 aa, Oenococcus kitaharae DSM 17330
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 363 - protein, 1389 aa, Oenococcus kitaharae DSM 17330; identical to SEQ ID NO: 362

SEQ ID NO: 364 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 365 - protein, 1535 aa, Ornithobacterium rhinotracheale
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 366 - protein, 1443 aa, Parabacteroides johnsonii DSM 18315
MIKLLYLEKLKQYTMKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 367 - protein, 1424 aa, Parabacteroides sp. D13
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 368 - protein, 1428 aa, Parasutterella excrementihominis YIT 11859
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRRGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVRSICNAIENERKTYGPYFSEDYKFVKTALKEGKTEKELSKKFAAVIKVLKMVSEVVPFIGKELRLSDEAQSKFDNLYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGTSDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 369 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 370 - protein, 1058 aa, Pasteurella multocida subsp. gallicida X73
MQTTNLSYILGLDLGIASVGWAVVEINENEDPIGLIDVGVRIFERAEVPKTGESLALSRRLARSTRRLIRRRAHRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKESAESATFMELKAWHAIRKALENQGLKDTWQDLAKKPDLLDEIGTAFSLYKTDEDIQQYLEGKLPDSVINALLVSLNFDKFIELSLKSLRKILPLMEQGKRYDQACHEIYGHHYGEKNQQISQLLPVIPTQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKVRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYVGLKARLAEFNQDPAKAFATPFYKQGGQQVKAIRVELVQKSGVLVRQGNGVADNAPGSIVRTDVFIKNNKFFLVPIYTWQVAKGILPNKAIVAHKNEDEWEEMDEGAKFKFSIFPNDLIELRTKTECFLGYYIGPDRHNGSISLREHDSEISKGNAGVYRVGVKLALSLEKYHIDELGKNRRICRPHQRRPVR

SEQ ID NO: 371 - protein, 1056 aa, Pasteurella multocida subsp. multocida str. P52VAC
MQTTNLSYILGLDLGIASVGWAVVEINENEDPIGLIDVGVRIFERAEVPKTGESLALSRRLARSTRRLIRRRARRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVFLNFDKFIELALKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKIRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 372 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 373 - protein, 1364 aa, Pediococcus acidilactici DSM 20284
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDFREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTGNFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLQPYFVYDNFKKFGNKEDIGHKRFNFLGKIEREKKVVAPETGEILWSNVAPNETIKQIKKVYDYKFMIVSREITTRRAELFNQTVYPKNYHGKLIPIKEDRPTDLYGGYSGNTDAYLAIVALEDKKKGKYFKVVGIPTRVAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 374 - protein, 1366 aa, Pediococcus acidilactici MA18/5M
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNNVWENIESILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRAELFNQTVYPKNYRGKLIPIKEDRPTDLYGGYSGNTDAYLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 375 - protein, 1364 aa, Peptoniphilus duerdenii ATCC BAA-1640
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 376 - protein, 1087 aa, Phascolarctobacterium succinatutens YIT 12067
MLRMKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 377 - protein, 1333 aa, Planococcus antarcticus DSM 14505
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 378 - protein, 1197 aa, Porphyromonas sp. oral taxon 279 str. F0450
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 379 - protein, 1485 aa, Prevotella bivia JCVIHMP010
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDIICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGKRNYDTIPLNIAAERLNQQLSPVPETNENNTPLKFYLSPNDLVYVPSEEERHSGNNIQLDKNRIYKMVSSTSKRCFFIHHRVAISLVDKKEFSAQNKMERSIDNEQVMIKSVCWKLITDRLGNIIKVIK

SEQ ID NO: 380 - protein, 1457 aa, Prevotella buccae ATCC 33574
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGATLKTDKEGYVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQHWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIAEMNQNISKYNDGKPHQPILKVRITEPMGAKYRVGQTGNKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGNECHFIPYYVANVIYNKGGFNMQMHRPQS

SEQ ID NO: 381 - protein, 1218 aa, Prevotella buccalis ATCC 35310
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 382 - protein, 1422 aa, Prevotella denticola CRIS 18C-A
MTQKVLGLDLGTNSIGSSVRNLDLSDDLKGQLEFFSSDIFRSSVNKESNGREYSLAAQRSAHSRSRGLNEARRRKLWATLDLLIKYGFCPMSPESLMRWRTYDKQRGLFREYPIDDKNFNAWILLDFDGDGKPDYSSPYQLRRELVIRQFDFDQPIERYKLGRALYHIAQHRGFKSSKGETLSQQETNSKQSLTDDTADVAGEMKASEEKLSKGLSTYMKENNLLTVGAAFAQLEDEGVRVRNNNDYRAIRSQFQREIETIFKFQQGLSVENELYERLVSEKKNIGTIFYKRPLRSQRGNVGKCTLERTKPRCAIGHPLFEKFRAWTLINNIKVRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGERWKKLYHPSQIAIYRPVPANKDRSALRLGNPDIGAIKNPTVLRVLNTLRKRVNQLLDDGIISPDETRVVVETARELNDANRKWALDTYNRIRHDENEKIKKILAEFYPKRDNISTVDIDKARYVIDQREMDYFTEAKTYHKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQYAKDKEGKVLMKEGRPQINPTIKFVIRRELKYKKSSTDSGFASWDDLGKAIVDKELFALMKGQFPEGTSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 383 - protein, 1375 aa, Prevotella histicola F0411
MKKILGLDLGTTSIGWALVYESENTDEKSSIVRLGVRVNPLSVDEKGNFEKGKAITTNADRQQTHGARINLQRYKLRRENLKDCLQKQGWIGTEALCEEGKTSTFETYMLRAKAAEEEISLHELCRVLFMMNKKRGYKSNRKANNKEDGKLFDGMTVAKKLYEEHLTPAEYSFQLLSSGKKFKQEYYRSDLKEEFDRIWNEQQKYYPEILTDDFKQQLQGKSKGNTSKIFLGKYGIYSADLKGLDRKLQPLKWRVEALKQQVDKEVLAFVISDLNGQIASTSGLLGAISDRSKELYFNKQTVGQYLWTSLKETPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSIHPLYEEEKNLLYEELSVKEKLSKAEALKVLNKNSKQWDLNYKEIEGNRTQAVLYDCYNRIIVMTGHEEYNFKKLKASEIRSYVKTTFTGLGFNTDILEFDSSLTGHELEKQPMYQLWHLLYSYESDNSRTGNDALLRKLETAFGFPKEYAAVLSDVVFEDSYGNLSVKAMRKILPHLQAGLNYSQACEEAGYKHSRRSLTKNELDQKEYKEKLELLPKNSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKLISPDLKIDKVIDKGIREILKTRLAKFNGDAQKAFSNLDENPIYKDEAKKITLKRVSLEGVSSVIPLHTLKDREGKLVVGKDGKPVLGDYVQTSNNHHIAFYMDENGNLQDNVVSFFEAAERKSQGVPVIDKNYNHDKGWNFLFTMKQNEYFVFPNEVTGFNPSEVDLMDEANYSIISPNLYRVQKMSKASGRDYWFRHHLEAMLNDDPKLRNSMFKRITSLKALEGIVKVRINCIGKIVAVGEYD

SEQ ID NO: 384 - protein, 1380 aa, Prevotella intermedia
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 385 - protein, 1425 aa, Prevotella micans F0438
MIQKIFGLDLGTNSIGSSVRNLELGENLTEQLEFFSSDIFGSSVSKNSNGREYSLAGNRSAHRRSRGLNEARRRKLWATLDLLIEHGLCPMSPDSLMQWRTYDKQKGLYRQYPIEDKDFNAWIMLDFNGDGKPDYSSPYQLRRELVVRQFDFDQPIERYKLGRALYHIAQHRGFKSSKGETIADQEKNEKKPIAEEGADIANEMKASETKLSKGLVAYMQENHLKTVGEAFAKLEDERVRIRNNESYRAIRSQYQDEIKEIFTYQKKLSVESELYERLTSEKKGVGTIFYKRPLRSQRGNVGKCTLERNKPRCPIGRPEFEEFRAWTLINNIKIRETAGEPYKQLPIKLRQELLKDCFLSKVKADFKFEDIRKYIEKRLGLSFSNDDKTINYKDSVSIAACPVTVRMKKLLGENWANCRIDGEKRRQAHGKNNNNEHIVSYTEEDIWHVCYNAEDPEEVSNFARKALHWDENKIKELVRLWTSIPQGYAMLSLKAIRNINRMLLLGLKYSDAVLLAKLPDIVPVSDEDILAITKEFLQLEDKLNQEKQINNIVNSLIANYKSKLEENRFADHNYQYQLGEGDDEDINTQIKSHIGAKLWVQIGADEQTKIFQAVRSKYQDFFKSYKRKFVESPKLGELLVAFLTEKFPNVKSKQWERLYHPSQIAIYRPIPVDNDRSKLRLGNPNIGAIKNPTVMRVLNTLRRRVNQLLDDGVISPDETRVVVETARELNDANTKWALDRYNRIRRDENEKIRKILKELNPTTNSISEQDIDKARYIFEQCETDFYTDGKVPYYNKDIKKYKLWLEQGGQCLYTGQTINLTNLFNPNAFDMEHTIPKSISFDNSDQNLTLCESYYNRFIKKNNIPTDMPNYDKDVTINGKEYTAIKPRLQRWKERVDRLSRNVDFWKGQARRAQDKDRKDECIREKHLWDMELAYWKGKLERFTMTDVTDGFKNSQLVDTRVITRHAVLYLKSIFNHVEVQRGETTAEFRKILGLQSIDEKKDRSLHSHHAIDATMLTVIPSAAKRDRMLELFYKIEETKKALKNYNDNNKTGLNLELKGLEEKLDKEKKDCRVGRRVNDLDRFINENIIVSHHTKDQALTPAHRRLRKRGKIVGGKEHPRWQTGDSLRGEIHKASYYGAITQFAKDANGKVLMKDGQAQIDPTIYYVIRRELKYKRSTQDSGFTNWEDLEKVIVDTDLFGLMKGQFPEGTSFKDACEQGFYMIKKGKNGEGDVKTHRIRHVRCKAVKTALRIKEQTYKSSKDYKQFFYAAVGDLYVMCYYTDGKKRDFKIYSLYDISNHRKSGTEDIPKFITDKKGNHLPLDYKLRTGDMVLLYKDNPEELKDLDQVNLKRRLYKVNRFESEGLIILLTHHLSTTTERGCSIGKIENYQNLPTAIRCGIKTIKFLIMGKHRDFVIRNGNIEFKH

SEQ ID NO: 386 - protein, 1506 aa, Prevotella nigrescens ATCC 33563
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 387 - protein, 1380 aa, Prevotella nigrescens F0103
MKRILGLDLGTTSIGWALVNEAESNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKLQPLKWRVEALKQQVDKEVLAFVISDLKGQIANTSGLLGAISDRSKELYFNKQTVGQYLWASLEENPHISIKNKPFYRQDYLDEFEKIWETQATFHKQLTPELKQEIRDIIIFYQRPLKSKKSLISVCELEQRKVKATIDGKEKEITIGPKVAPKSSPVFQEFRIWQNLNNVLLIDNDTNEKRPLDEDERYLLYKELSIKAKLSKTEALKILNKKGKQWDLNYKELEGNRTQAILFDCYNRIITLTGHEECDFKKIKASEIRHYVSTIFKNLGFSTEILDFDPSLEKHELEKQPMYQLWHLLYSYESDNSRTGNESLLRKLETTFGFPEEYATVLCDVVFEEDYGNLSVKAMRKILPYLQAGNDYSQACAYAGYNHSRHSLTKEELDQKVYKERLELLPKNSLRNPVVEKILNQMINVINAIIDEYGKPDEIRIEMARELKSSAADRKKTTHAINQGNDENQCIREILEKEFALSYISRNDIIKYKLYEELKPNGFKTLYSDTYIPKDKLFSKDFDIEHIIPKARLFDDSYSNKTLEARDINLAKSNKTAFDFVKEKYGEQGAEAYKKKLDMLLGNNVISKPKYNKLLMTEADIPSDFINRDLRNTQYIARKACEILGELVRTVTPTTGKITNRLREDWQLVDVMKELNFEKYEKLGLTEIVEDRDGRKIKRIKDWTKRNDHRHHAMDALAIAFTKPSYIQYLNNLNARSNKGDSIYAIENKELHYEEGKLRFNAPIPVNVFRAEAKRHLSAILVSIKAKNKVMTQNVNKIKTKHGIIKKIQLTPRGPLHNETIYGTKMRPIIKKVKVGAALDEATINKVSSPAIREVLLKRLNEYSGNAKKAFTGKNTLDKNPIYLNAERTKTVPASVKTVEWENYHPIRKPITPDLKVDKVIDKGIGEILKARLEEFNGDAKKAFSNLEENPIYLDQTKKIALKRVSIEGVLSTIPLHTLKNQAGKPIMGKDGKPVLGNYVQTSNNHHIAFYYDEDGNLQDNAVSFFEAAERKSQGISVIDKDYNRDKGWRFLFTMKQNEYFVFPNEATGFIPSEVDLTDEANYGIISPNLYRVQKMSRIEKGTSVSRDYWFRHHLETILNDDSRLKNSAFKRINSLKPLEGIIKVRINSIGKIVAVGEYD

SEQ ID NO: 388 - protein, 1391 aa, Prevotella oralis ATCC 33269
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 389 - protein, 1204 aa, Prevotella ruminicola
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 390 - protein, 1424 aa, Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 391 - protein, 1483 aa, Prevotella sp. MSX73
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGTTLKTDKEGNVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQRWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIVEMNQNISKYNDGKPHQPILKVRITEPMGAKYRVGQTENKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGSECHFIPYYVANVIYNKVEFEAKNKIGRALTGEMIKAVCWKLEIDRLGNILKVIK

SEQ ID NO: 392 - protein, 1375 aa, Prevotella sp. oral taxon 306 str. F0472
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 393 - protein, 1216 aa, Prevotella stercorea DSM 18206
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 394 - protein, 1234 aa, Prevotella tannerae ATCC 51259
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 395 - protein, 1487 aa, Prevotella timonensis CRIS 5C-B1
MKNILGLDLGSNSVGWALVKVEENGNPIGSIKMGSRIIPMSQDILGSFEKGDTVSQTAQRTLYRGKRRLIERHVLRRERLCRVLHIMNFLPAHFDRLLGWDKTDNKTYGKFIDDSEPKLAWRQNKNEMGKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKKKSDIPLYDWVGKTLQLIVVTTYEKDGKTPKIFDSGKQNPSYRLPKEDDWGLVKKRTESQLQSSGKTVGAFIYDNILSKPDDKIRGNLVRTIERKYYKKELIEILQQQAKYHDELHNQNLLESCAKELYAHNDVHYNEVIKSNMINLLVNDIIFYQRPLKSKKSLIANCKYESYEYVDKETGEIKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKSYPCNETRYELLSALKRAGMDKQWLDDTPNMQYRLWHLLYSVEEKEESAKALRKLYDDDKFVTSFLKIKPFNKCYGAYSEKAIKRLLTLMRMGKAWNEQAIDAKTLKCIQQIITDNVDSKLKEKIDDSRYVLHHVSDFQGLPTYLASYVIYGRHSEVTDIQCWDSPEDLLKFIRDFKQHSLRNPIVEQVILETLRVVYDIWKAEKHIDEIHVEVAREMKLTAQQRNEANLRNLNNEATNLRIKYLLEELKNDTFIKDVRPLSPIHQEKMRIYEQAVLGNLNKQDKDYDDIIKISKKEHPTNAELIRYKLWLEQRYCSPYTGKAISLSKLFTTAYEIEHIIPQSRYFDNSFNNKVICEAEVNKAKGNMLGYEFIKKQGGQKIYCTQLGKAVTILKEEAYKQFVNEHYAHNKRKRDNLLAENIPESFSSRQLNDTRYITKTIMSLLSNVVRQQSEEEATAKNLLPSSGSVTDRLKNDWGLKDVWNTIVTPRFERLNKLSGTNDFGEMKEENGNRYFQTNVPLEYEKGFKKKRIDHRHHAMDALVIACTTRNMVNYISNANANSPKQREDLRQLLCDKNRIINKPWDTFTQDALKALNDIVVSFKNNVRIINRATNRYQRYDKNGKKIIFSQKGDDMWAIRKSMHKETVFGRVNLIRKEVLPIAKALDNISAICNAQLRAYVNDLVDKHFNKKQLVAHFKSLNYKWNRQDVSKVEVWISSDNKTPMVAVRKPLDTSFDKKKIASITDTGIQTILLNYLESKGGDASVAFAPEGIQEMNSNIELYNNGKAHKPIKNVRLSEPLGAKYQVGERGAKTKKYVEADKGTNLFFAIYEDEEGKRYYYSVPLREAIERQKQKLSPVPEYNEKGVALKFYLSPNDLVYVPTEEERTMGTCHIDKARIYKMVSSTGCSCYFVPSTFAKVIVDKVELQSLNKMEKAITDECIKEVCWKLKVDRLGNIINVIK

SEQ ID NO: 396 - protein, 1218 aa, Prevotella timonensis CRIS 5C-B1
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 397 - protein, 1496 aa, Prevotella veroralis F0319
MKTILGLDLGTNSIGWAKVCVDDNGNYLRDIKLGSRIIPMSQDVLGNFDKGVTESQTSVRTGFRGVRRIRERSLLRRERLHRVLHVLGYLPPHYDSAIGWNKNEPSTYGKFLNHGEPKLAWEHKEDGSMRFLFMESFHEMMADFAKSQPSLVSDGKKIPLDWTIYYLRKKALSQPIRKEELAWLLLNFNQKRGYYQLRGEEDDDNPTKCEEYYELKVVGIEADEEGKNGNTWYNVKLENGWIYRRQSKIPLDDWIGKVREFIVTTEYEKDGITLKKDKNGDVKRSFRSPSEDDWGLRKKRTEKLLDSSKMTVGAFVYDHLLAEPSDKIRGKFIRTIERKYYKKELYAILCEQSKYHEELRSGDYLNKCAEELYKNNQPHRNSLLTKDLAYLLLEDLIFYQRPLKTKKSLIAECPYEAYKYVDKETGEIKRQGIKCIAKSNPYYQEFRLWQFISNLRLFNKADDKEVTADYLPTQDDYVRLFAYLNDRKEINQETLLKEFFKLKKITVNSEKVFPIRWNYIEDKEKKYPCNETRHELLLALDRARIDHSWLEKPGQEYRLWHLLYSVESKEETKEALRKLKDDDAFVESFLKVKPFKREYGAYSEKAIKKLLAVMRMGSLWRETDICDTTKGNITKILQGEIDEKLKEKISASVSSYNQLSDFQGLPVWLACYVVYGRHSEAAEIQHWKTPESLLAYINGFKQHSLRNPIVEQCILETLRTVHDIWKEVGHIDEIHVELGRNMKSTADQRARISENVLRNENTNLRIKSLLLELKNDPNIKDVRPYSPMQQEKLRIYEEGVLQELTKDDKDFTEITKISTMAQPSAKELQRYKLWLEQKYRSPYTGKSISLTKLFTSAYQIEHVIPQSRYFDDSFSNKVICESEVNSLKDNMLGYEFIKNHGGEIIHCTMLGDVKVLSESEYKAFVNDHYAHNKRKRENLLLEDIPQEFLNRQMNDSRYISKVVKALLSNIVRAEGEEEATSKFVVSCSGGITDRLKKDWGLNDVWNKIVYPRFERLNRLTGTEAFGQWENKDGKRVFQTAVPLELQRGFNKKRIDHRHHAMDALVIACTSRNIINYLNNESANNPKKREDLRQKLCDKNRTIRKPWETFTQDATAALEDVIVSFKNYVRIINKATNYYERYDVEGKKVIAEQRGDDMWAIRKPMHEATYYGRVNLRRKKKVNLRVALENISSICDNKLRIYINGLVEKGFNTKQILDKFKNTNDHFSMQKIDKVEIWQFTNEEEKLVATRKPLDTSFDTKKIASITDTGIQTILLNYLETKGGDSTIAFTPEGIVEMNQNISKYNNGKEHMPILKVRLYTKLGKKIPVGQTGCKAKQFVIAEAGTNLYFAIYEDEEGKRSYRTIPLNEVVERLKQGLSPVPEKNDKDVHLKFYLSPNDLVYVPIEDEHESLAKDHIYKFVDSSGTTANFIPHRSANVIFELNKKDAEKFCSGSIIQNEYGVGSSQSKNQKAITGEMIKAVCRKLEVDRLGNVIKVI

SEQ ID NO: 398 - protein, 1062 aa, Ralstonia syzygii R24
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 399 - protein, 1066 aa, Rhodopseudomonas palustris
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 400 - protein, 1064 aa, Rhodopseudomonas palustris
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 401 - protein, 1173 aa, Rhodospirillum rubrum ATCC 11170
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 402 - protein, 1059 aa, Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 403 - protein, 1405 aa, Riemerella anatipestifer
MKTILGLDLGTNSIGWALVKEAENSNEKSEIIKLGVRVNPLTVDEKTNFEAGRPLSTNADRTAKRSARRNLQRYKLRRKNLIDLLIKNQLIDKDTPLTEIGKNTTHQTLELRAKAARERIELEDLARVFLAINKKRGYRSSRKVNNEEEGQAVDGMAVAKKLYDENLTPGQYAYELLSKGKKYVPDFYRSDLQAEFNAIWEYQKQFYADILDDELYNALKGQGQQNSRKRFLAIKGVYTAENKGKRDDVKLRHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVIIFYQRKLKSQKGLLSFCQFESWEIERKDENGNVILNKTTQLPKRQTVGRRVAPKSSPLFQEFKIWQNINNLEVTKISEGASKNKKETETLSDDERKLLFEELNLRGNLSQKEVLQILGLKDKEYKTNFSEGLEGNRTNAALFNIYQQIAENEGYGFDWSKKSAQEIKEELKAVFPQIGIQADILDFNANLDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRELLDKLELLPKNSLRNPVVEKILNQMVNVVNQVIETYGKPDEVRIELARELKKSAEKRAEMTKSINEATRRNEDIKKLITKDFGIPNPTKSDVVRYRLWEELAPLAYKDVFTGKQIKKEDLFSSKIDIEHIIPKALLFDDSFSNKTLVFRETNLKKADRTAYDFIESDYNATLDDYIQRVETLYNNTKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKRVEVITDWTKRNDHRHHAMNALTVAFTTSSHIQYLNYLNARKNESHKEHKNIKGIENKITHKQKDKRKFIPPMPNFREEAKKHIETILVSIKNKNKVYTKNINKTKKKSGHNTKEQLTPRGQLHKETVYGKSKRPMSKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKKKGICIKRVTITGVSNAEALHHQKDHLGREILDDNGNPIPADFVSTGNNHHLAVYLDSEGKLQDNIVSFYEAVVRTSQGLPVVDKGLNKDLGWKFLFSLKQNEMFVFPNDDFDINDFDLLDDKKAELISKHLYRVQKISKVSAGNSFVRDIVFRHHLETTVKEVKELKDISYIQLKSLEGLRNIKKVRINHIGKIVQVGEY

SEQ ID NO: 404 - protein, 1400 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKEKGICIKRVTITGVSNAEALHHQKDHLGREILDDNGNPIPADFVSTGNNHHVAIYEDEKGKLQEKVVSLYEAVARANQGLPVVDKGLNEDLGWKFLFTMKQNEMFVFPNDDFDVNDIDLLDENNAKIISQHLFRVQKLATKNYMFRHHLETNVQEVKELNDIAYKSIRSTEPLKNIKKVRINHIGKIVQVGEY

SEQ ID NO: 405 - protein, 1140 aa, Roseburia intestinalis L1-82
MRENGSDERRRNMDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 406 - protein, 1128 aa, Roseburia intestinalis M50/1
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 407 - protein, 1152 aa, Roseburia inulinivorans DSM 16841
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 408 - protein, 1156 aa, Ruminococcus albus 8
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 409 - protein, 1341 aa, Ruminococcus lactaris ATCC 29176
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 410 - protein, 1471 aa, Scardovia wiggsiae F0424
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 411 - protein, 1178 aa, Scardovia inopinata F0304
MGKRHNSNMAKKKISYRIGIDVGLNSTGLAAIEVDDDGAPIRILNTMSVIHDGGVDPDAAKVRGTRLAISGIARRTRRMRRRRAKRLDRLEQILEKYGYTDTEPVLEEPYGPWICRAELADGFINDDEQRRMMIGIAIRHIARHRGWRNPYQNVRALLNIDDSDLSEEYKNLKEKVQDQINDGKDLPNFTPSQLVRDYLDNFSGQPAARIRTGKAGPRGNRRDAVGILPQRMRQSDYAYELQRIFDMQKIGRDEAQELLMAVFEAKSPKGSAEKRIGKDPLTGKKRALKASLAFQKYRIVATITNLRIKTGTGSERMLSPTELNDIYTYLLRVQDDNHLPTWEDICEEVLHIGRYQLAGIGKTFEGGERISNMPPVIQTSLAIHGLSEGTLAEKLTKWWDKADDDSRESMIKLLSNTVDIDRVNEVDENFASALDFIDSLDDEELTKLDKIALPRGRAAYSEEALNKLTADMLNTGDDLFSARQRIYHVNNSWRPPQPPIGEPLGNPAVDRVLKITNRYLMNCLNRWGQPRRVTIEHTRSGFTSVKQATEHQKISDKRAEYRRDIVKQLEEAGVESVHEYDIRRWEAVQRQNGQCLYCGRDITFKTCEMDHIVPRKGPGSTNTRTNFAAVCPECNRMKSNIPFASWAETKEAKDRGVSLDKAIKQVRFFNFTKNEYSPQAQRNFKKSMIERLKQKTSDEPLDNRSIESVSWMADELYKRIDWYFNHEQYETSKKAINDDKDNLSGTQVVVYPGSITAEARNAAGLGGNIHFIGGRYKTRLDRRHHAVDACVIAMMEPGIARILTERNQLRQAQRLTARIEDDEVNWKDYPTENTAGYNKYQAWSDRMHALLEYMNNALDYDKIPVVRWERLQLGNRSAHEDTIHPLKKLPLSHEISAIDINHASTPALYEALVSLPDFSEQDGLPADPSRQINVNGERYSGDDLVSFFNSNAAQIAIQGGSAELGTAFHHARIYRCWTVGKNGKKKIFFGMIRVYQHDLLHAKNEDLFTYPLKRSSVSMRYAKKEVVHAILSGNAEYVGYLCVGDELVLDLKGDKSNDEGGSRLSGQVGEFVQKFEEDSKVNSQIVNRWTVDGFPDEAKLRLRPSMFAGEGLKNMKSELVENAAIKNILSKTGWRVSVDVISKKSPVVLRRNAFGEPRWKTNAGLPVSYRWQDTETKE

SEQ ID NO: 412 - protein, 1063 aa, Simonsiella muelleri ATCC 29453
MEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 413 - protein, 1327 aa, Solobacterium moorei F0204
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 414 - protein, 1179 aa, Sphaerochaeta globosa
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 415 - protein, 1426 aa, Sphingobacterium spiritivorum ATCC 33861
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 416 - protein, 1110 aa, Sphingobium sp. AP49
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 417 - protein, 1090 aa, Sphingomonas sp. S17
MDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 418 - protein, 1084 aa, Sporolactobacillus vineae DSM 21990 = SL153
MKYSIGLDIGISSVGWSVINLDRERIELMGARLFDAAENPKNGSSLAAPRRDARSARRRLRRRRYRVGRVRHFIIDRGLVTRGQADQLFDWKDGDLDIWLVRVNALERLLTDREFARVLIHIAKNRGYRSNRKSEAKSGENGQVLSAIKANKELMEEKGYQTVAEMLVNEPETFAGRKRNRGGEYTHVIARSELEHEIRLIFTKQRAFGNRFATEENENTYVKIWAAQRPVATKDDILKKIGDCTFEKGEKRAPKASYAFQYFRALDKLNRLRILSVREPSRNLTDDERNLIVPALFNHDKQKYSDLRKILQLRDDQKFNELFYDPGKSLKENENKTFLSLAEQYKIRKVIRDVQGKDGLLQYRPLDIDTIAYALTVFKDDQDTRDYLSNTFVNGNGKQVLNLANRAFDAELIDGLLSLSFAKFGHLSLKALHKLIPHMEQGLSYYDACKKVGYHDNEQVGKSKQHLLPVIPADEIRNPVVVRSLSQTRKVINAIIKRYGSPTFMYIELAREMGRPYNERRDLEKQYNKNRTVNDSAIEQIHELYPEIGAPRGHDILKYKLWQQQDCKCAYSLEKIPAEKIFEPGYAEVDHIIPYSRSFDDSNSNKVLVLSRMNQEKKNRTPYEWFGGDEHRWNKFESYVNALKVNRKKKSLLTKKNMDTEEEDTFKSRHLNDTRYITRFIKSFVEDNLLFREIEGAKQHVFTVNGAYTSLMRKRWGFNKNREESDLHHSVDAVIIAVSQPFRNEVSRYFKHREISLPQLLKRTWDYFPEPWEGFVKELRARTLQDPEKLKLALESLDLDSYDPEFIDEVKPIFISRMPKRSIKGQIHDETLRRNRGKTKDGFVKIVTRTRLENIKFDKNGDFPMYGRESDPKTYQAIKQRYLENNKDKKKAFIEPLYKPAKNPNNASLIRSVKIEDKANQIVPLRDEAVAYNASIVRTEVYRNKETGKFYLAPVYVSDVFAGREPRRFIRANVPYEQWVNITDKFTFLFNLYPNDVIYIKMKKVKTTKSNINKTISWQESYFYFKGTDIHTGAITIIDHMNSFTDRVGTQGLQLFEKYQVDPLGNLSRVHGETQYGVPALSHS

SEQ ID NO: 419 - protein, 1053 aa, Staphylococcus aureus subsp. aureus; identical to SEQ ID NO: 24

SEQ ID NO: 420 - protein, 1054 aa, Staphylococcus lugdunensis M23590
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 421 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 422 - protein, 1334 aa, Staphylococcus pseudintermedius ED99; identical to SEQ ID NO: 421

SEQ ID NO: 423 - protein, 1112 aa, Staphylococcus simulans ACS-120-V-Sch1
MLVGLKFKQSILFENMENAEDIKESATGSDAISLSDDYYENLSEFLTDEQLNFIESANTFFMGIMLDRILKGATSISAAKVRDYKIFKSQLKLIKDIVYQNKYDKYHEFFVTSKEDMRAYQENPDAKNFGKLSKFDQYLIHSKDQYAKLMKDLKGLVPKEYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAILGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISNLFGAPEKIIIEFATEDQAKGKRQKSRSELWDDLVKKNNLKRNKEFEGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEYGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAYERINGKQLEFDIAMQRKIKQALSPYNNMTEQEKVEFYNQFAEKVIEEFRNSIGLQSRDRKVNLIKNLFNNTEKSNDSMTQSILEVLKMTKVSAERSKELKIRWNGQTPNTFIDTKNNAEIQYKSITGLKTTKPKSIFKLAESKNEL

SEQ ID NO: 424 - protein, 1370 aa, Streptococcus agalactiae 2603V/R
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 425 - protein, 1377 aa, Streptococcus agalactiae 515
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 426 - protein, 1370 aa, Streptococcus agalactiae; identical to SEQ ID NO: 424

SEQ ID NO: 427 - protein, 1378 aa, Streptococcus agalactiae ATCC 13813
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 428 - protein, 1370 aa, Streptococcus agalactiae CJB111
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 429 - protein, 1370 aa, Streptococcus agalactiae COH1
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 430 - protein, 1370 aa, Streptococcus agalactiae FSL S3-026
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 431 - protein, 1370 aa, Streptococcus agalactiae GB00112
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 432 - protein, 1370 aa, Streptococcus agalactiae H36B
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 433 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 434 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 435 - protein, 1370 aa, Streptococcus agalactiae STIR-CD-17
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 436 - protein, 1125 aa, Streptococcus anginosus 1_2_62CV
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 437 - protein, 1345 aa, Streptococcus anginosus F0211
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 438 - protein, 1386 aa, Streptococcus anginosus SK1138
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 439 - protein, 1396 aa, Streptococcus anginosus SK52 = DSM 20563
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 440 - protein, 1373 aa, Streptococcus bovis ATCC 700338
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 441 - protein, 1375 aa, Streptococcus canis FSL Z3-227
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 442 - protein, 1345 aa, Streptococcus constellatus subsp. constellatus SK53
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 443 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 444 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 445 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 446 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 447 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 448 - protein, 1377 aa, Streptococcus equinus ATCC 9812
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 449 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 450 - protein, 1370 aa, Streptococcus gallolyticus subsp. gallolyticus TX20005; identical to SEQ ID NO: 449

SEQ ID NO: 451 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 452 - protein, 1130 aa, Streptococcus gallolyticus
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 453 - protein, 1136 aa, Streptococcus gordonii
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 454 - protein, 1129 aa, Streptococcus infantarius subsp. infantarius ATCC BAA-102
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 455 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 456 - protein, 1368 aa, Streptococcus iniae 9117
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 457 - protein, 1338 aa, Streptococcus macacae NCTC 11558
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 458 - protein, 1130 aa, Streptococcus macedonicus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVPTETGKLSTEQKESLVEFAKNTAILGPAKLLKEIAKILDCKVDEIKGYREDDKGKPDLHTFEPYRKLKFNLDSVNIDYLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKSLNKPNISIYKVRTDVLGNKYFVKKEGDKPKLDFKNNKK

SEQ ID NO: 459 - protein, 1134 aa, Streptococcus mitis ATCC 6249
MNGLVLGLDIGIASEGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIYNQYKYEIDHILPLSLSFDDSLSNKVLALATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENEPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGDKPKLKF

SEQ ID NO: 460 - protein, 1392 aa, Streptococcus mitis SK321
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 461 - protein, 1345 aa, Streptococcus mutans 11SSST2
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 462 - protein, 1345 aa, Streptococcus mutans 11SSST2; identical to SEQ ID NO: 461

SEQ ID NO: 463 - protein, 1345 aa, Streptococcus mutans 11VS1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 464 - protein, 1345 aa, Streptococcus mutans 14D
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 465 - protein, 1355 aa, Streptococcus mutans 15VF2
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 466 - protein, 1355 aa, Streptococcus mutans 15VF2; identical to SEQ ID NO: 465

SEQ ID NO: 467 - protein, 1345 aa, Streptococcus mutans 1SM1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 468 - protein, 1345 aa, Streptococcus mutans 1SM1; identical to SEQ ID NO: 467

SEQ ID NO: 469 - protein, 1350 aa, Streptococcus mutans 24
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRICKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 470 - protein, 1350 aa, Streptococcus mutans 24; identical to SEQ ID NO: 469

SEQ ID NO: 471 - protein, 1345 aa, Streptococcus mutans 2VS1; identical to SEQ ID NO: 464

SEQ ID NO: 472 - protein, 1345 aa, Streptococcus mutans 2VS1; identical to SEQ ID NO: 464

SEQ ID NO: 473 - protein, 1345 aa, Streptococcus mutans 3SN1; identical to SEQ ID NO: 463

SEQ ID NO: 474 - protein, 1345 aa, Streptococcus mutans 3SN1; identical to SEQ ID NO: 463

SEQ ID NO: 475 - protein, 1345 aa, Streptococcus mutans 4SM1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 476 - protein, 1345 aa, Streptococcus mutans 4SM1; identical to SEQ ID NO: 475

SEQ ID NO: 477 - protein, 1345 aa, Streptococcus mutans 4VF1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 478 - protein, 1345 aa, Streptococcus mutans 4VF1; identical to SEQ ID NO: 477

SEQ ID NO: 479 - protein, 1345 aa, Streptococcus mutans 5SM3
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 480 - protein, 1345 aa, Streptococcus mutans 5SM3; identical to SEQ ID NO: 479

SEQ ID NO: 481 - protein, 1359 aa, Streptococcus mutans 66-2A
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 482 - protein, 1359 aa, Streptococcus mutans 66-2A; identical to SEQ ID NO: 481

SEQ ID NO: 483 - protein, 1345 aa, Streptococcus mutans 8ID3
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 484 - protein, 1345 aa, Streptococcus mutans 8ID3; identical to SEQ ID NO: 483

SEQ ID NO: 485 - protein, 1345 aa, Streptococcus mutans A19
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 486 - protein, 1345 aa, Streptococcus mutans A19; identical to SEQ ID NO: 485

SEQ ID NO: 487 - protein, 1345 aa, Streptococcus mutans B; identical to SEQ ID NO: 464

SEQ ID NO: 488 - protein, 1345 aa, Streptococcus mutans G123; identical to SEQ ID NO: 464

SEQ ID NO: 489 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 490 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 491 - protein, 1345 aa, Streptococcus mutans M21
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 492 - protein, 1345 aa, Streptococcus mutans M21; identical to SEQ ID NO: 491

SEQ ID NO: 493 - protein, 1345 aa, Streptococcus mutans M230
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 494 - protein, 1345 aa, Streptococcus mutans M230; identical to SEQ ID NO: 493

SEQ ID NO: 495 - protein, 1345 aa, Streptococcus mutans M2A
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 496 - protein, 1345 aa, Streptococcus mutans M2A; identical to SEQ ID NO: 495

SEQ ID NO: 497 - protein, 1345 aa, Streptococcus mutans N29
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 498 - protein, 1345 aa, Streptococcus mutans N29; identical to SEQ ID NO: 497

SEQ ID NO: 499 - protein, 1345 aa, Streptococcus mutans N3209
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 500 - protein, 1345 aa, Streptococcus mutans N3209; identical to SEQ ID NO: 499

SEQ ID NO: 501 - protein, 1345 aa, Streptococcus mutans N66
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 502 - protein, 1345 aa, Streptococcus mutans N66; identical to SEQ ID NO: 501

SEQ ID NO: 503 - protein, 1350 aa, Streptococcus mutans NFSM1
MKKPYSIGLDIGTNSVGWAVVTDDYKVPAKKMTVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKTPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 504 - protein, 1350 aa, Streptococcus mutans NFSM1; identical to SEQ ID NO: 503

SEQ ID NO: 505 - protein, 1345 aa, Streptococcus mutans NLML1; identical to SEQ ID NO: 477

SEQ ID NO: 506 - protein, 1338 aa, Streptococcus mutans NLML4
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 507 - protein, 1338 aa, Streptococcus mutans NLML4; identical to SEQ ID NO: 506

SEQ ID NO: 508 - protein, 1128 aa, Streptococcus mutans NLML5
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 509 - protein, 1128 aa, Streptococcus mutans NLML5; identical to SEQ ID NO: 508

SEQ ID NO: 510 - protein, 1125 aa, Streptococcus mutans NLML8
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLEAAKLLKEIAKLVGCQVEEIKGYRLDNKDKPDLHTFEPFRKLKSNLTTIAVENLSITTLDTLAHILTLNTEREGIEEAIQKELPNIFSDEQITGIIAVRKKNSQIFGKGWHSFSIKLMKELIPELYETSEEQMTILIRLKKVKTNSKITNRTKYINEQEVTDEIYNPVVSKSIRQTVKIINAAIKKYGAFDQIVIEMPRESNEEDERKFIADLQKSNAKEKDDAMKQAALLYNGKAELPHGVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 511 - protein, 1125 aa, Streptococcus mutans NLML8; identical to SEQ ID NO: 510

SEQ ID NO: 512 - protein, 1345 aa, Streptococcus mutans NLML9
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 513 - protein, 1345 aa, Streptococcus mutans NLML9; identical to SEQ ID NO: 512

SEQ ID NO: 514 - protein, 1355 aa, Streptococcus mutans NMT4863
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 515 - protein, 1355 aa, Streptococcus mutans NMT4863; identical to SEQ ID NO: 514

SEQ ID NO: 516 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 517 - protein, 1345 aa, Streptococcus mutans NV1996; identical to SEQ ID NO: 463

SEQ ID NO: 518 - protein, 1345 aa, Streptococcus mutans NVAB
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 519 - protein, 1345 aa, Streptococcus mutans NVAB; identical to SEQ ID NO: 518

SEQ ID NO: 520 - protein, 1345 aa, Streptococcus mutans R221
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 521 - protein, 1345 aa, Streptococcus mutans R221; identical to SEQ ID NO: 520

SEQ ID NO: 522 - protein, 1345 aa, Streptococcus mutans S1B
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 523 - protein, 1345 aa, Streptococcus mutans S1B; identical to SEQ ID NO: 522

SEQ ID NO: 524 - protein, 1345 aa, Streptococcus mutans SF1; identical to SEQ ID NO: 463

SEQ ID NO: 525 - protein, 1345 aa, Streptococcus mutans SF14
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 526 - protein, 1345 aa, Streptococcus mutans SF14; identical to SEQ ID NO: 525

SEQ ID NO: 527 - protein, 1345 aa, Streptococcus mutans SM1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 528 - protein, 1345 aa, Streptococcus mutans SM1; identical to SEQ ID NO: 527

SEQ ID NO: 529 - protein, 1345 aa, Streptococcus mutans SM4
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 530 - protein, 1345 aa, Streptococcus mutans SM4; identical to SEQ ID NO: 529

SEQ ID NO: 531 - protein, 1345 aa, Streptococcus mutans SM6
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 532 - protein, 1345 aa, Streptococcus mutans SM6; identical to SEQ ID NO: 531

SEQ ID NO: 533 - protein, 1134 aa, Streptococcus mutans ST1
MANGKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNMRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIVKLVGCSADDIKGYRIDKSDKPEIHTFEAYRKMRTMELIKVDDLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKKAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKSYVKGLKTLSNKKKDYLLTEENIDKIEVKQKFIERNLVDTRYSSRVVLNALQDFYKERKFDTKISVVRGQFTSQLRRKWRIEKTRETYHHHAVDALIIAASSQLNLWKKQNNPLISYKEDQFVDPETGEILSLSDDEYKKLVFKAPYEHFVDTLKSKKFEDSILFSYQVDSKYNRKISGATICGTRKAQLGKDTQEETYVLGKIKDIYSQKGYEDFIKKYKKDKTQFLMYHKDPQTFEKVIEEILKTYPDKELNEKGKEVSCNPFEKYRQENGPVRKYSKKGNGPEIKSLKYYDEVLGKNIDITPKNSLNKVVLRSLNPWRTDVYFNHETRKYEFLGLKYSDLRYLKGEHRYGILIGDYKKIKDKEGIEKESEFKFTLYKNDLILIKDTAKGKEELFRFWSRTGKDNAKTFEKNKIELKPYSKSQFEKGEDTNVLGKLYASSNQLQKSFGTLENLSIYKVRTDVLGNKYFIKKEGDKPQLNFKKKL

SEQ ID NO: 534 - protein, 1134 aa, Streptococcus mutans ST1; identical to SEQ ID NO: 533

SEQ ID NO: 535 - protein, 1350 aa, Streptococcus mutans ST6
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYSFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRIRKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 536 - protein, 1350 aa, Streptococcus mutans ST6; identical to SEQ ID NO: 535

SEQ ID NO: 537 - protein, 1125 aa, Streptococcus mutans U2A
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLGAAKLLKEIAKLVGCQVEEIKGYRLDNKDKPDLHTFEPFRKLKSNLTTIAVENLSITTLDTLAHILTLNTEREGIEEAIQKELPNIFSDEQITEIIAVRKKNSQIFGKGWHSFSIKLMKELIPELYETSEEQMTILTRLKKVKTNSKITNRTKYINEEEITDEIYNPVVSKSIRQTVKIINATIKKYGAFDQIIIEMPRESNEEDERKFIADLQKSNAKEKDDAMKQAALLYNGKDELPHDVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 538 - protein, 1125 aa, Streptococcus mutans U2A; identical to SEQ ID NO: 537

SEQ ID NO: 539 - protein, 1345 aa, Streptococcus mutans UA159
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 540 - protein, 1345 aa, Streptococcus mutans W6; identical to SEQ ID NO: 464

SEQ ID NO: 541 - protein, 1121 aa, Streptococcus oralis SK1074
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKCRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKEYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 542 - protein, 1373 aa, Streptococcus oralis SK304
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 543 - protein, 1134 aa, Streptococcus oralis SK313
MNGLVLGLDIGIASVGVGILEKNSGKIVHASSRIFPAATADNNVERRKNRQARRLHRRKKHRGARLKDLFEYYGLLTDFSKVSINLNPYRLRVDGLDQQLTNEELFIALKNIVKRRGISYLDDASEDGGTVSSDYGKAVEENRKLLAEQTPGQIQLERFEKYGQLRGDFTVVENSEKCRLINVFSTSAYKKEAERILRKQQEFNNQITDEFIEDYLKILTGKRKYYHGPGNEKSRTDYGRFRTDGATLDNIFGILIGKCTFYPNEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETISVGELSRNILDELAHILTLNTEREGIEEAINTKLRDSFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 544 - protein, 1371 aa, Streptococcus oralis SK610
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 545 - protein, 1140 aa, Streptococcus parasanguinis F0449
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 546 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 547 - protein, 1374 aa, Streptococcus pseudoporcinus LQ 940-04
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 548 - protein, 1368 aa, Streptococcus pyogenes MGAS10270
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 549 - protein, 1371 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 550 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 551 - protein, 1368 aa, Streptococcus
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 552 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 553 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 554 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 555 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 556 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 557 - protein, 1368 aa, Streptococcus pyogenes M1 GAS [sequence omitted]

SEQ ID NO: 558 - protein, 1368 aa, Streptococcus pyogenes; identical to SEQ ID NO: 552

SEQ ID NO: 559 - protein, 1370 aa, Streptococcus ratti FA-1 = DSM 20564
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 560 - protein, 1127 aa, Streptococcus salivarius
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 561 - protein, 1385 aa, Streptococcus salivarius K12
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 562 - protein, 1135 aa, Streptococcus salivarius PS4
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLACDIADIKGYRIDKSDKAEIHTFEAYRKMKTLETIDIEQIEREKLDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFKAHKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYALGTKTPSKTGFYKFLDLYNKDKSQFLVYQKDRKTWDEVIEKIMEQYRPFKESDKNGKEVDFNPFEKYRIENGPIRKYSRKGNGPEIKSLKYYASKLGNHIDITPKDSNNKVVLQSVSPWRADVYFNKTTGSYEILGLKYADLQFEKGTGTYRISEEKYNDIKKKEGVDSDSEFKFTLYKNDLLLIKDTETKEQRLFRFLSRSMPNKKHYVELKPYSKDKFEKNESLIEILGSADKSGRCIKGLAKSNLSIFKVRTDVLGNQHIIKNEGDKPKLDF

SEQ ID NO: 563 - protein, 1377 aa, Streptococcus sanguinis SK115
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 564 - protein, 1392 aa, Streptococcus sanguinis SK330
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 565 - protein, 1370 aa, Streptococcus sanguinis SK353
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 566 - protein, 1421 aa, Streptococcus sanguinis SK49
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 567 - protein, 1026 aa, Streptococcus sp. BS35b
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFIDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKKYELMGLKYSDLSFEKGSGKYSISNEKYNSIKRIEGVNEQSEFKFTLYK

SEQ ID NO: 568 - protein, 1139 aa, Streptococcus sp. C150
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 569 - protein, 1377 aa, Streptococcus sp. C300
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 570 - protein, 1371 aa, Streptococcus sp. F0441
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 571 - protein, 1121 aa, Streptococcus sp. GMD6S
MNGLVLGLDIGIASVGVGILEKNSGKIIHANSRLFPAATADNNVERRKNRQARRLHRRKKHRGVRFQDLFEDYGLLTDFSKVSINLNPYRLRVDGLNQQLTNEELFIALKNIVKRRGISYLDDASEDGGTVSSDYGKAVEENRKLLAEQTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPDEYRASKASYTAQEFNLLNDLNNLTVPTETKKLSEEQKKVIVEYAKEAKTLGASTLLKYIAKMIDASVDQIRGYRVDVNNKPEIHTFEAYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKEISKRTKYIDEKELTEEIYNPVVAKSVRQAIKIINEATKKHGIFDNIVIEMARENNEEDAKKDYIKRQKANQDEKNAAMEKAAFQYNGKKELPDSIFHGQKELATKIRLWHQQGEKCLYTGKNIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 572 - protein, 1375 aa, Streptococcus sp. M334
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 573 - protein, 1371 aa, Streptococcus sp. oral taxon 056 str. F0418
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 574 - protein, 1420 aa, Streptococcus sp. oral taxon 071 str. 73H25AP
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIEKIDKNFYRRLDESFRVLGDKSEDIQIKQPFFGNKELETAYHKKYPTIYHLRKHLADADKNSPVADIREVYMVLSHILKYRGHFLTLGKIDPNNINMQNSWIDFIESCQDAFDLEISDESKTIAAIFKSSENRQEKVKQILSYFQQELLKKDKSIFKQLLQLLFGLKTKFKDCFELEEEPDLNFSKENYDENLENLLGALEEDFSDVFAKLKILRDTILLSSMLTYTGATHARFSATMVERYEEHRKDLQRFKSFVKQNLSEQDYLDIFGRKTPTGFDVDKETKGYVGYISNKMVLTNPQKQKTIQQNFYDYISGKITGIEGAECFLNKISDGTFLRKLRTTDNGAIPNQIHAYELEKIIERQGRDYPFLLENKDKLLSILTFKIPYYVGPLAKGNNSRFAWIKRTTSQDVLDDNDEDTRNGKIRPWNYHKLINMDETRDAFIINLIGNDIILLNEKVLPKRSLIYEEVMLQNELTRVKYKDKYGKIHFFNSELRQEIINNLFKTNSKRVSSAMLLSYLENFTNLQAVEIVSGIEKGKSLNSTLKTYNDLKTIFSEELLDSEIYQKELEEIIKVITVFDDKKSIKNYLTKYFGHLEFLNEEKINQLSKLRYTGWGRYSGKLLLGIRDEDTGFNLMQFLRNDDENRNLTQLISDTTLSFDSAIKAIQSKSTVEDDVFEEIKNLAGSPAIKRGILNSIKIVDELVQIIGYPPQNIIIEMARENMTTEEGQKKAKTRKSKLESALKNIEDSVLESGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATLRKHLYSNIMRFFNNPDSKVSKDIWDCNRDLPIVKDVIYNSQINFVKRTMIKKGAFYNQNPVGKLNKQIAANNRYPLKTKVSSLDTSIYGGYGPMNSALSIIIIAERFNEKKGKIETVKEFHDIFIIDYEKFNNNPFQFLNNVSEEGFLKKNDLNRVLAFYRISKYSLMQKIDGTRMLFESKSNLHKVTQFKLTKTQNELFFHMKRLLTKSNLMDLKSESAIKESQNFIQTHQNEFDNIADRLSNYSQKMLGETKSLQTLINGYNERPIKQIDNNEETIRYYYDNFIKMFSFVKSGAPKDIINFFNDKYTVPRMRPKPDRKMLDATLIHQSITGLYETRIDLSKLGED

SEQ ID NO: 575 - protein, 1122 aa, Streptococcus suis 89/1591
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 576 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWDEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 577 - protein, 1381 aa, Streptococcus suis
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDRYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRINRLENALKDFGSKILEEQKPYGVSKVNNIHLQSDRLFLYYLQNGKDMYTDEELDIDHLSEYDIDHIIPQAFIKDDSLDNKVLTKSAKNRGKSDDVPSMEIVHNRKNFWRQLLKSKLISQRKFDNLTKAERGGLTNEDKARFIQRQLVETRQITKHVARMLDTRFNTKLDEAGNRIRDPKVNIITLKSNLVSQFRKDYQLYKIREINNYHHAHDAYINAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 578 - protein, 1122 aa, Streptococcus suis; identical to SEQ ID NO: 575

SEQ ID NO: 579 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 580 - protein, 1128 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKRLRLQIKQNISNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 581 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKEYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASIQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPVNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 582 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 583 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 584 - protein, 1122 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 585 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 586 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILKRLGKQKTTSSSNKTKYIDEKLLTEEIYNPVVAKSIRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNDPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 587 - protein, 1122 aa, Streptococcus thermophilus MTCC 5460
MSDLVLGLDIGIGSVGVGILNKVTGEIIHKNSRIFPAAQAENNVERRTNRQGRRLTRRKKHRRVRLNRLFEESGLITDFTKISINLNPYQLRVRGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKASSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKLSDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRADVYFNKTTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 588 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSVSPWRADIYFNNTTGKYEILGLKYADLQFEKGTGTYKISQEKYNDIKKKEGVDSDSEFKFTLYKNDLLLVKETETKEQQLFRFLSRTMPKQKHYVELKPYDKQKFEGGEALIKVLGNVANGGQCIKGLGKSNISIYKVRTDVLGNQHIIKNEGDKPKLDF

SEQ ID NO: 589 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVCEINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 590 - protein, 1128 aa, Streptococcus vestibularis ATCC 49124
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 591 - protein, 1084 aa, Subdoligranulum sp. 4_3_54A2FAA
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 592 - protein, 1422 aa, Sutterella wadsworthensis 3_1_45B
MTQSERRFSCSIGIDMGAKYTGVFYALFDREELPTNLNSKAMTLVMPETGPRYVQAQRTAVRHRLRGQKRYTLARKLAFLVVDDMIKKQEKRLTDEEWKRGREALSGLLKRRGYSRPNADGEDLTPLENVRADVFAAHPAFSTYFSEVRSLAEQWEEFTANISNVEKFLGDPNIPADKEFIEFAVAEGLIDKTEKKAYQSALSTLRANANVLTGLRQMGHKPRSEYFKAIEADLKKDSRLAKINEAFGGAERLARLLGNLSNLQLRAERWYFNAPDIMKDRGWEPDRFKKTLVRAFKFFHPAKDQNKQHLELIKQIENSEDIIETLCTLDPNRTIPPYEDQNNRRPPLDQTLLLSPEKLTRQYGEIWKTWSARLTSAEPTLAPAAEILERSTDRKSRVAVNGHEPLPTLAYQLSYALQRAFDRSKALDPYALRALAAGSKSNKLTSARTALENCIGGQNVKTFLDCARRYYREADDAKVGLWFDNADGLLERSDLHPPMKKKILPLLVANILQTDETTGQKFLDEIWRKQIKGRETVASRCARIETVRKSFGGGFNIAYNTAQYREVNKLPRNAQDKELLTIRDRVAETADFIAANLGLSDEQKRKFANPFSLAQFYTLIETEVSGFSATTLAVHLENAWRMTIKDAVINGETVRAAQCSRLPAETARPFDGLVRRLVDRQAWEIAKRVSTDIQSKVDFSNGIVDVSIFVEENKFEFSASVADLKKNKRVKDKMLSEAEKLETRWLIKNERIKKASRGTCPYTGDRLAEGGEIDHILPRSLIKDARGIVFNAEPNLIYASSRGNQLKKNQRYSLSDLKANYRNEIFKTSNIAAITAEIEDVVTKLQQTHRLKFFDLLNEHEQDCVRHALFLDDGSEARDAVLELLATQRRTRVNGTQIWMIKNLANKIREELQNWCKTTNNRLHFQAAATNVSDAKNLRLKLAQNQPDFEKPDIQPIASHSIDALCSFAVGSADAERDQNGFDYLDGKTVLGLYPQSCEVIHLQAKPQEEKSHFDSVAIFKEGIYAEQFLPIFTLNEKIWIGYETLNAKGERCGAIEVSGKQPKELLEMLAPFFNKPVGDLSAHATYRILKKPAYEFLAKAALQPLSAEEKRLAALLDALRYCTSRKSLMSLFMAANGKSLKKREDVLKPKLFQLKVELKGEKSFKLNGSLTLPVKQDWLRICDSPELADAFGKPCSADELTSKLARIWKRPVMRDLAHAPVRREFSLPAIDNPSGGFRIRRTNLFGNELYQVHAINAKKYRGFASAGSNVDWSKGILFNELQHENLTECGGRFITSADVTPMSEWRKVVAEDNLSIWIAPGTEGRRYVRVETTFIQASHWFEQSVENWAITSPLSLPASFKVDKPAEFQKAVGTELSELLGQPRSEIFIENVGNAKHIRFWYIVVSSNKKMNESYNNVSKS

SEQ ID NO: 593 - protein, 1049 aa, Tistrella mobilis
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 594 - protein, 1395 aa, Treponema denticola AL-2
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSELQHIGGSKYSGVAKIGNKISSLDNCILIYQSITGIFEKRIDLLKV

SEQ ID NO: 595 - protein, 1395 aa, Treponema denticola ASLM
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKFNRLTRATPISDDETAKFIARQLVETRQATKVAARVLEKMFPETKIVYSKAETVSMFRNKFDIVKCREINDFHHAHDAYLNIVVGNVYNTKFTNNLWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 596 - protein, 1395 aa, Treponema denticola ATCC 35405
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 597 - protein, 1395 aa, Treponema denticola H1-T
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 598 - protein, 1395 aa, Treponema denticola H-22
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGAFSNISKYGGYNKVSAAYYTLIEYEEKGNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNPDNCILIYQSITGIFEKRIDLLKV

SEQ ID NO: 599 - protein, 1395 aa, Treponema denticola OTK
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMELDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSAYVGVCKITHKKLVIKNSASQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 600 - protein, 1395 aa, Treponema denticola SP37
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPNDYKKVFGYNKNEKNNNNYSAYVGVCKTKSKKLVINNTVNQEDFYKFLKPILLAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKNSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDSLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 601 - protein, 1062 aa, Treponema sp. JC4
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEKIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 602 - protein, 1011 aa, uncultured delta proteobacterium HF0070_07E19
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 603 - protein, 1032 aa, uncultured Termite group 1 bacterium phylotype Rs-D17
MLYHIANHRGTDSVRSFLEYDDDKIKENTLTAKIAKETKKVIDAKKYRTFGEYLYKGKIEKFQQNIRKKVSNRKTPANKNKEFAVTRDVIIKETEKILASQKQYYTYILTDEYIKKIKDAISYQTEKLIPESGYCPYFKDEKRLPRSHKLNEYRRMYEALNNAKYFDPVLDENTGEILSYQEKEFSREEKKILFDEVLLKGMELTESGAKKLLYHLPDGCEVQLQGRDKTTQKIKGYALVDLEASPFWLRLSQQQQDEFLYDWNSLPLEKLKPKLTNYYSLTESEVDETFQEIKLPSNYASVGKKAMEILLTYIKDGCSYTEALEKAVSEGKLKVDKQTMIYDSLPYYGKILKESTQKLIGKAFSKQFADRNYKEPDTNKNEREFGKIANPVVHQTLNELRKLINEIITVFGKKPLEIGLETTRELKKSKKNREYLSKQQNKNEYARNRIYKEYIEPHLSQIKSRQENPSKYISKFELLEEQNFICPFCSEKITPDDIINSKVDVEHIFPIEESEDITKNNLVIAHNECNADKGKKSPFDAFGDKTSGKYRWNCILHNAQKNLPHKVWRFYQGSLEKFLENKPMSRRFGTDNSYISKIAARYLACLFNDPYHSEIFCIKSSLIAQLRIAWDLNSIMVPLVKNILSEKELEEFKISKNKKIRIDNRHHALDAIVIAYANRGYHNFLNRIHAKEYKINYREKSWLSKILLPPLNRDLEDFKISVKDSIEKANVSIKHDHNTNGSLVKATAYKVYYSGAGEYIITTSKNVEEISFKEKEDPKDTLYRALCKFECRDIDIKDEKLIKKLKYNSTLYKKVQNNLSKAKQELEQDNKKTEEEGKKSQKITEVRIYKKACSLVKGQYIQCGSRLKDKFFAVKEPTEIKTGLGYDTGDNLFLDLYYDKTGKLCGEIIRKVNFNRNKPNYQKEGYTLFERIYQSDILEVDTSEDRISLKNKTGSAPSDRTFIKVNTFTEVNAYFDGKRDKIQIFFGNLLKSSFKNDSFFISSMQKYNVRKVILTSLGIIKYRSQILKNKEV

SEQ ID NO: 604 - protein, 1398 aa, Veillonella atypica ACS-134-V-Col7a
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 605 - protein, 1398 aa, Veillonella parvula ATCC 17745
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 606 - protein, 1395 aa, Veillonella sp. 6_1_27
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYTDQDYYKEYPTIYHLRVALMKSGTDDIRKLFLAVHHILKYRGNFLYEGATFDSNASTLDDVLKQALENITFNCFDSSAAIGSIGQILMELGKTKSDKAKAIERLVDTYIITDEVDTSGKTQKEQVKEDKKRLKSFANLVLGLSASLTDLFGSVEDLDEDLKKLQIIGDTYDERRDDLAKVWGDEIHIIDDCKSVYDAIILMSIKEPGLTISESKVKAFKKHKDDLAILKSLLKSDRSIYNTMFKVDEKGLHNYVHYIKQGRTEETSCNREDFYKYTKKVVEGLPDSKDKEYILSEIELQTLLPLQRIKDNGVIPYQLHLEELKVILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKAVKEHLIEAVFKQDHKKMTKNRIEQFLKDNNYIPEKHKPEITGLDGEIKNDLASYRDMVRILGNNFDLSMAEEIITDITIFGESKKMLRETLRNKFSSRLDDEAIKKLSKLRYRDWGRLSRKLLNVIEGCDKAGDGTPETIIILMRNFSYNLMELLGDKFSFMERIQEINAKLIEGQIVNPHDIIDDLALSPAVKRAVWQALRIVDEIVHIKKTLPARIFVEVTRSNKAEKKKKDSRQKRLSDLYAAIKKDDALLSGLTNEEFGGLKSGLAKYDDAALRSKKLYLYYTQMGRCAYTGEVIDLSQLNTDNYDIDHIYPRSLTKDDSFDNLVLCKRTANAQKSDTYPISKEIQKAQKAFWIFLKQQGLISERKYERLTRITPLTADDLSGFIARQLVETNQSVKAATTLLRRLYPGVDVVFVKAENVTDFRHDNDFIKVRSLNHHHHAKDAYLNIVVGNVYHERFTRNFRAFFKKNGANRTYNLAKMFNYDVKCTNAKDGKAWAVKTSMDTVKKMMDSNDVRVTKRVYEQKGQLSDINLTKASKVKADIYLPIKANDPIMSQNMKYGGYSDIKNAYYTIIEYSDKKNNSIKAFIPIPIFIATKTLTKQALLEYIKTVLPKANNLRIIYKKVYNDQLLKIDGFNYYLGGRSNDRFCIDNAIQLIVPLEIQFYIKLVEKFTAIISENKNIALKASSVKSRNPINNQVENITLEYTQKLFDYLVSKFNELIYLKMRGNKLTDVNNIGRKQFIKLSLEERCKALAELLNIFTNMNKKLSLSTINVSASRKVVNFKISSLDEFKIVNESITGLYSHEITIV

SEQ ID NO: 607 - protein, 1120 aa, Veillonella sp. oral taxon 780 str. F0422
MGFKANLVNLFTDEDIEVILPEEKEFKSINLHEGIYEDVRDAYEDAWGDRFAIVDQCKVLHDIIVISSIIKPGQSLSEAKIESYNQHKEDLVLLKSVLKEDRKLYDDMFVVDTDKGTNYVKYTKQGVNGNTSATQEEFYKYVRKVVSVLPETEHTRRIVQKLEEGTFLPLQRISKNGVVPYQLHKEELVRILDKATVNFPFLNKVENGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDHAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGEKEKTAFEMLEDLSLSPMVKRSVWQTLRILDEIVSIRKELPKKIFVEVARTNKADKKRTQSRKALLEELYKQIKDEDVHVLQQELESKEDSALNSKKLYLYFTQMGRCMYSGRRIDIHELFTDKYDIDHIYPRSLTKDDSWHNIVLVEKQLNAEKTDRFPILSAIQSKQKGFWKLLWDRGFISEKKYDRLVRTTDLTDEELNQFINRQMVSTNQSVKAVTTLLHQLYPETEVVFSKAENVSDFRHDYDFVKVRSINHHHHAKDAYLNIVVGNVYHEKFTKNFLSFAKQKGTRRTYNLTKIFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSIDSAVDVVMDITSSVYIKLLEKVAIKKIENPKTFRIENIKTSYNHKEVTVSKEQNIALYQELLKKLDTPLFSKMKGNKLEEFRTVGFDTFIALSLEEQASVLLEVLNVLTNFKTKRDITKIGMTSSRSTLGINISNTEQFSVITTSITGLYEQEIKIK

SEQ ID NO: 608 - protein, 1068 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 609 - protein, 1440 aa, Weeksella virosa
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 610 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 611 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 612 - protein, 1388 aa, Zunongwangia profunda
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 613 - RNA, 22 nt, Homo sapiens
ugcucagguugcacagcuggga

SEQ ID NO: 614 - RNA, 22 nt, Homo sapiens
ucccagcugugcaaccugagca

SEQ ID NO: 615 - RNA, 22 nt, Homo sapiens
ucagguguggaaacugaggcag

SEQ ID NO: 616 - RNA, 22 nt, Homo sapiens
cugccucaguuuccacaccuga

SEQ ID NO: 617 - RNA, 22 nt, Homo sapiens
caaaaccgcgauuacucuugca

SEQ ID NO: 618 - RNA, 22 nt, Homo sapiens
ugcaagaguaaucgcgguuuug

SEQ ID NO: 619 - RNA, 21 nt, Homo sapiens
aaaaguaauugugguuuuugc

SEQ ID NO: 620 - RNA, 21 nt, Homo sapiens
gcaaaaaccacaauuacuuuu

SEQ ID NO: 621 - RNA, 21 nt, Homo sapiens
aaaaacugcaaucacuuuugc

SEQ ID NO: 622 - RNA, 21 nt, Homo sapiens
gcaaaagugauugcaguuuuu

SEQ ID NO: 623 - RNA, 22 nt, Homo sapiens
caaaagugauugugguuuuugc

SEQ ID NO: 624 - RNA, 22 nt, Homo sapiens
gcaaaaaccacaaucacuuuug

SEQ ID NO: 625 - RNA, 22 nt, Homo sapiens
agcaguguuuguuuugcccaca

SEQ ID NO: 626 - RNA, 22 nt, Homo sapiens
ugugggcaaaacaaacacugcu

SEQ ID NO: 627 - RNA, 22 nt, Homo sapiens
ucgggcgcaagagcacugcagu

SEQ ID NO: 628 - RNA, 22 nt, Homo sapiens
acugcagugcucuugcgcccga

SEQ ID NO: 629 - RNA, 21 nt, Homo sapiens
acacuuguugggaugaccugc

SEQ ID NO: 630 - RNA, 21 nt, Homo sapiens
gcaggucaucccaacaagugu

SEQ ID NO: 631 - RNA, 24 nt, Homo sapiens
aggagcuauccacuccaggugucc

SEQ ID NO: 632 - RNA, 24 nt, Homo sapiens
ggacaccuggaguggauagcuccu

SEQ ID NO: 633 - RNA, 23 nt, Homo sapiens
ccagagcagccugcgguaacagu

SEQ ID NO: 634 - RNA, 23 nt, Homo sapiens
acuguuaccgcaggcugcucugg

SEQ ID NO: 635 - RNA, 22 nt, Homo sapiens
aguugccagggcugccuuuggu

SEQ ID NO: 636 - RNA, 22 nt, Homo sapiens
accaaaggcagcccuggcaacu

SEQ ID NO: 637 - RNA, 21 nt, Homo sapiens
uagaccaucuuucuagaguau

SEQ ID NO: 638 - RNA, 21 nt, Homo sapiens
auacucuagaaagauggucua

SEQ ID NO: 639 - RNA, 22 nt, Homo sapiens
agcucuagaaagauuguugacc

SEQ ID NO: 640 - RNA, 22 nt, Homo sapiens
ggucaacaaucuuucuagagcu

SEQ ID NO: 641 - RNA, 21 nt, Homo sapiens
gggacuaggaugcagaccucc

SEQ ID NO: 642 - RNA, 21 nt, Homo sapiens
ggaggucugcauccuaguccc

SEQ ID NO: 643 - RNA, 23 nt, Homo sapiens
aggucugcauucaaauccccaga

SEQ ID NO: 644 - RNA, 23 nt, Homo sapiens
ucuggggauuugaaugcagaccu

SEQ ID NO: 645 - RNA, 20 nt, Homo sapiens
cauuacagcacagccauucu

SEQ ID NO: 646 - RNA, 20 nt, Homo sapiens
agaauggcugugcuguaaug

SEQ ID NO: 647 - RNA, 21 nt, Homo sapiens
ucuggcugugcuguaaugcag

SEQ ID NO: 648 - RNA, 21 nt, Homo sapiens
cugcauuacagcacagccaga

SEQ ID NO: 649 - RNA, 21 nt, Homo sapiens
ugacuucuaccucuuccaaag

SEQ ID NO: 650 - RNA, 21 nt, Homo sapiens
cuuuggaagagguagaaguca

SEQ ID NO: 651 - RNA, 22 nt, Homo sapiens
uuggaauaggggauaucucagc

SEQ ID NO: 652 - RNA, 22 nt, Homo sapiens
gcugagauauccccuauuccaa

SEQ ID NO: 653 - RNA, 22 nt, Homo sapiens
ucguaucagagauuccagacac

SEQ ID NO: 654 - RNA, 22 nt, Homo sapiens
gugucuggaaucucugauacga

SEQ ID NO: 655 - RNA, 23 nt, Homo sapiens
acugggaugucacugaauauggu

SEQ ID NO: 656 - RNA, 23 nt, Homo sapiens
accauauucagugacaucccagu

SEQ ID NO: 657 - RNA, 22 nt, Homo sapiens
caaaguccuuccuauuuuuccc

SEQ ID NO: 658 - RNA, 22 nt, Homo sapiens
gggaaaaauaggaaggacuuug

SEQ ID NO: 659 - RNA, 21 nt, Homo sapiens
gaagaauaggagggacuuugu

SEQ ID NO: 660 - RNA, 21 nt, Homo sapiens
acaaagucccuccuauucuuc

SEQ ID NO: 661 - RNA, 22 nt, Homo sapiens
ugggccaugcauuucuagaacu

SEQ ID NO: 662 - RNA, 22 nt, Homo sapiens
aguucuagaaaugcauggccca

SEQ ID NO: 663 - RNA, 21 nt, Homo sapiens
ucuagaaaugcaugacccacc

SEQ ID NO: 664 - RNA, 21 nt, Homo sapiens
ggugggucaugcauuucuaga

SEQ ID NO: 665 - RNA, 22 nt, Homo sapiens
uuccacugccacuaccuaauuu

SEQ ID NO: 666 - RNA, 22 nt, Homo sapiens
aaauuagguaguggcaguggaa

SEQ ID NO: 667 - RNA, 21 nt, Homo sapiens
auuagguaguggcaguggaac

SEQ ID NO: 668 - RNA, 21 nt, Homo sapiens
guuccacugccacuaccuaau

SEQ ID NO: 669 - RNA, 21 nt, Homo sapiens
caccgacucugucuccugcag

SEQ ID NO: 670 - RNA, 21 nt, Homo sapiens
cugcaggagacagagucggug

SEQ ID NO: 671 - RNA, 22 nt, Homo sapiens
cagcaggggagagagaggaguc

SEQ ID NO: 672 - RNA, 22 nt, Homo sapiens
gacuccucucucuccccugcug

SEQ ID NO: 673 - RNA, 22 nt, Homo sapiens
uuccagcccuucuaaugguagg

SEQ ID NO: 674 - RNA, 22 nt, Homo sapiens
ccuaccauuagaagggcuggaa

SEQ ID NO: 675 - RNA, 22 nt, Homo sapiens
uaccauuagaagagcuggaaga

SEQ ID NO: 676 - RNA, 22 nt, Homo sapiens
ucuuccagcucuucuaauggua

SEQ ID NO: 677 - RNA, 21 nt, Homo sapiens
ucaagugucaucugucccuag

SEQ ID NO: 678 - RNA, 21 nt, Homo sapiens
cuagggacagaugacacuuga

SEQ ID NO: 679 - RNA, 23 nt, Homo sapiens
uuugggauugacgccacaugucu

SEQ ID NO: 680 - RNA, 23 nt, Homo sapiens
agacauguggcgucaaucccaaa

SEQ ID NO: 681 - RNA, 21 nt, Homo sapiens
cugccuguucuuccacuccag

SEQ ID NO: 682 - RNA, 21 nt, Homo sapiens
cuggaguggaagaacaggcag

SEQ ID NO: 683 - RNA, 23 nt, Homo sapiens
uauggaguggacuuucagcuggc

SEQ ID NO: 684 - RNA, 23 nt, Homo sapiens
gccagcugaaaguccacuccaua

SEQ ID NO: 685 - RNA, 22 nt, Homo sapiens
ccucaccaucccuucugccugc

SEQ ID NO: 686 - RNA, 22 nt, Homo sapiens
gcaggcagaagggauggugagg

SEQ ID NO: 687 - RNA, 23 nt, Homo sapiens
caggcagaaguggggcugacagg

SEQ ID NO: 688 - RNA, 23 nt, Homo sapiens
ccugucagccccacuucugccug

SEQ ID NO: 689 - RNA, 20 nt, Homo sapiens
ucucuucaucuaccccccag

SEQ ID NO: 690 - RNA, 20 nt, Homo sapiens
cugggggguagaugaagaga

SEQ ID NO: 691 - RNA, 21 nt, Homo sapiens
uuggaggguguggaagacauc

SEQ ID NO: 692 - RNA, 21 nt, Homo sapiens
gaugucuuccacacccuccaa

SEQ ID NO: 693 - RNA, 22 nt, Homo sapiens
cugccagccccguuccagggca

SEQ ID NO: 694 - RNA, 22 nt, Homo sapiens
ugcccuggaacggggcuggcag

SEQ ID NO: 695 - RNA, 23 nt, Homo sapiens
acaaaguacagcauuagccuuag

SEQ ID NO: 696 - RNA, 23 nt, Homo sapiens
cuaaggcuaaugcuguacuuugu

SEQ ID NO: 697 - RNA, 23 nt, Homo sapiens
aaaggucauuguaagguuaaugc

SEQ ID NO: 698 - RNA, 23 nt, Homo sapiens
gcauuaaccuuacaaugaccuuu

SEQ ID NO: 699 - RNA, 22 nt, Homo sapiens
ugaggcuaaugcacuacuucac

SEQ ID NO: 700 - RNA, 22 nt, Homo sapiens
gugaaguagugcauuagccuca

SEQ ID NO: 701 - RNA, 24 nt, Homo sapiens
uauagagagcaggaagauuaaugu

SEQ ID NO: 702 - RNA, 24 nt, Homo sapiens
acauuaaucuuccugcucucuaua

SEQ ID NO: 703 - RNA, 23 nt, Homo sapiens
gugcuucaucguaauuaaccuua

SEQ ID NO: 704 - RNA, 23 nt, Homo sapiens
uaagguuaauuacgaugaagcac

SEQ ID NO: 705 - RNA, 24 nt, Homo sapiens
guggaaagcaugcauccagggugu

SEQ ID NO: 706 - RNA, 24 nt, Homo sapiens
acacccuggaugcaugcuuuccac

SEQ ID NO: 707 - RNA, 22 nt, Homo sapiens
agacacauuuggagagggaacc

SEQ ID NO: 708 - RNA, 22 nt, Homo sapiens
gguucccucuccaaaugugucu

SEQ ID NO: 709 - RNA, 22 nt, Homo sapiens
uucccuuugucauccuaugccu

SEQ ID NO: 710 - RNA, 22 nt, Homo sapiens
aggcauaggaugacaaagggaa

SEQ ID NO: 711 - RNA, 21 nt, Homo sapiens
gcugggaaggcaaagggacgu

SEQ ID NO: 712 - RNA, 21 nt, Homo sapiens
acgucccuuugccuucccagc

SEQ ID NO: 713 - RNA, 21 nt, Homo sapiens
uaccacaggguagaaccacgg

SEQ ID NO: 714 - RNA, 21 nt, Homo sapiens
ccgugguucuacccuguggua

SEQ ID NO: 715 - RNA, 22 nt, Homo sapiens
ggcuggagcgagugcaguggug

SEQ ID NO: 716 - RNA, 22 nt, Homo sapiens
caccacugcacucgcuccagcc

SEQ ID NO: 717 - RNA, 18 nt, Homo sapiens
ccaggcucugcaguggga

SEQ ID NO: 718 - RNA, 18 nt, Homo sapiens
ucccacugcagagccugg

SEQ ID NO: 719 - RNA, 22 nt, Homo sapiens
cugggaggugugauauuguggu

SEQ ID NO: 720 - RNA, 22 nt, Homo sapiens
accacaauaucacaccucccag

SEQ ID NO: 721 - RNA, 22 nt, Homo sapiens
gggaggugugaucucacacucg

SEQ ID NO: 722 - RNA, 22 nt, Homo sapiens
cgagugugagaucacaccuccc

SEQ ID NO: 723 - RNA, 22 nt, Homo sapiens
ugugauaucaugguuccuggga

SEQ ID NO: 724 - RNA, 22 nt, Homo sapiens
ucccaggaaccaugauaucaca

SEQ ID NO: 725 - RNA, 22 nt, Homo sapiens
ugugauaucgugcuuccuggga

SEQ ID NO: 726 - RNA, 22 nt, Homo sapiens
ucccaggaagcacgauaucaca

SEQ ID NO: 727 - RNA, 18 nt, Homo sapiens
ggugggcuucccggaggg

SEQ ID NO: 728 - RNA, 18 nt, Homo sapiens
cccuccgggaagcccacc

SEQ ID NO: 729 - RNA, 18 nt, Homo sapiens
cacugcaggacucagcag

SEQ ID NO: 730 - RNA, 18 nt, Homo sapiens
cugcugaguccugcagug

SEQ ID NO: 731 - RNA, 17 nt, Homo sapiens
ugagggaggagacugca

SEQ ID NO: 732 - RNA, 17 nt, Homo sapiens
ugcagucuccucccuca

SEQ ID NO: 733 - RNA, 18 nt, Homo sapiens
gaggcugaaggaagaugg

SEQ ID NO: 734 - RNA, 18 nt, Homo sapiens
ccaucuuccuucagccuc

SEQ ID NO: 735 - RNA, 22 nt, Homo sapiens
gucacugaugucuguagcugag

SEQ ID NO: 736 - RNA, 22 nt, Homo sapiens
cucagcuacagacaucagugac

SEQ ID NO: 737 - RNA, 22 nt, Homo sapiens
accugucuguggaaaggagcua

SEQ ID NO: 738 - RNA, 22 nt, Homo sapiens
uagcuccuuuccacagacaggu

SEQ ID NO: 739 - RNA, 22 nt, Homo sapiens
agaguuaacucaaaauggacua

SEQ ID NO: 740 - RNA, 22 nt, Homo sapiens
uaguccauuuugaguuaacucu

SEQ ID NO: 741 - RNA, 22 nt, Homo sapiens
uguugggauucagcaggaccau

SEQ ID NO: 742 - RNA, 22 nt, Homo sapiens
augguccugcugaaucccaaca

SEQ ID NO: 743 - RNA, 17 nt, Homo sapiens
gaagauggacguacuuu

SEQ ID NO: 744 - RNA, 17 nt, Homo sapiens
aaaguacguccaucuuc

SEQ ID NO: 745 - RNA, 21 nt, Homo sapiens
ucugaauagagucugaagagu

SEQ ID NO: 746 - RNA, 21 nt, Homo sapiens
acucuucagacucuauucaga

SEQ ID NO: 747 - RNA, 22 nt, Homo sapiens
caaggagacgggaacauggagc

SEQ ID NO: 748 - RNA, 22 nt, Homo sapiens
gcuccauguucccgucuccuug

SEQ ID NO: 749 - RNA, 20 nt, Homo sapiens
aaaagcugggcugagaggcg

SEQ ID NO: 750 - RNA, 20 nt, Homo sapiens
cgccucucagcccagcuuuu

SEQ ID NO: 751 - RNA, 18 nt, Homo sapiens
aggcuggagugagcggag

SEQ ID NO: 752 - RNA, 18 nt, Homo sapiens
cuccgcucacuccagccu

SEQ ID NO: 753 - RNA, 22 nt, Homo sapiens
gcgacucugaaaacuagaaggu

SEQ ID NO: 754 - RNA, 22 nt, Homo sapiens
accuucuaguuuucagagucgc

SEQ ID NO: 755 - RNA, 20 nt, Homo sapiens
aaagacucugcaagaugccu

SEQ ID NO: 756 - RNA, 20 nt, Homo sapiens
aggcaucuugcagagucuuu

SEQ ID NO: 757 - RNA, 21 nt, Homo sapiens
acaggagugggggugggacau

SEQ ID NO: 758 - RNA, 21 nt, Homo sapiens
augucccacccccacuccugu

SEQ ID NO: 759 - RNA, 21 nt, Homo sapiens
cgucccaccccccacuccugu

SEQ ID NO: 760 - RNA, 21 nt, Homo sapiens
acaggaguggggggugggacg

SEQ ID NO: 761 - RNA, 18 nt, Homo sapiens
aggagaaguaaaguagaa

SEQ ID NO: 762 - RNA, 18 nt, Homo sapiens
uucuacuuuacuucuccu

SEQ ID NO: 763 - RNA, 22 nt, Homo sapiens
auggccagagcucacacagagg

SEQ ID NO: 764 - RNA, 22 nt, Homo sapiens
ccucugugugagcucuggccau

SEQ ID NO: 765 - RNA, 21 nt, Homo sapiens
ugggcucaggguacaaagguu

SEQ ID NO: 766 - RNA, 21 nt, Homo sapiens
aaccuuuguacccugagccca

SEQ ID NO: 767 - RNA, 21 nt, Homo sapiens
cacaggcuuagaaaagacagu

SEQ ID NO: 768 - RNA, 21 nt, Homo sapiens
acugucuuuucuaagccugug

SEQ ID NO: 769 - RNA, 22 nt, Homo sapiens
gugacugauaccuuggaggcau

SEQ ID NO: 770 - RNA, 22 nt, Homo sapiens
augccuccaagguaucagucac

SEQ ID NO: 771 - RNA, 22 nt, Homo sapiens
ugucguggggcuugcuggcuug

SEQ ID NO: 772 - RNA, 22 nt, Homo sapiens
caagccagcaagccccacgaca

SEQ ID NO: 773 - RNA, 17 nt, Homo sapiens
acagggaggagauugua

SEQ ID NO: 774 - RNA, 17 nt, Homo sapiens
uacaaucuccucccugu

SEQ ID NO: 775 - RNA, 17 nt, Homo sapiens
gccggacaagagggagg

SEQ ID NO: 776 - RNA, 17 nt, Homo sapiens
ccucccucuuguccggc

SEQ ID NO: 777 - RNA, 17 nt, Homo sapiens
uuggaggcguggguuuu

SEQ ID NO: 778 - RNA, 17 nt, Homo sapiens
aaaacccacgccuccaa

SEQ ID NO: 779 - RNA, 18 nt, Homo sapiens
cucgaguuggaagaggcg

SEQ ID NO: 780 - RNA, 18 nt, Homo sapiens
cgccucuuccaacucgag

SEQ ID NO: 781 - RNA, 21 nt, Homo sapiens
cacggcaaaagaaacaaucca

SEQ ID NO: 782 - RNA, 21 nt, Homo sapiens
uggauuguuucuuuugccgug

SEQ ID NO: 783 - RNA, 22 nt, Homo sapiens
agauuguuucuuuugccgugca

SEQ ID NO: 784 - RNA, 22 nt, Homo sapiens
ugcacggcaaaagaaacaaucu

SEQ ID NO: 785 - RNA, 17 nt, Homo sapiens
ggugggggcuguuguuu

SEQ ID NO: 786 - RNA, 17 nt, Homo sapiens
aaacaacagcccccacc

SEQ ID NO: 787 - RNA, 20 nt, Homo sapiens
ggcuccuuggucuaggggua

SEQ ID NO: 788 - RNA, 20 nt, Homo sapiens
uaccccuagaccaaggagcc

SEQ ID NO: 789 - RNA, 22 nt, Homo sapiens
cgucccggggcugcgcgaggca

SEQ ID NO: 790 - RNA, 22 nt, Homo sapiens
ugccucgcgcagccccgggacg

SEQ ID NO: 791 - RNA, 22 nt, Homo sapiens
uggggauuuggagaagugguga

SEQ ID NO: 792 - RNA, 22 nt, Homo sapiens
ucaccacuucuccaaaucccca

SEQ ID NO: 793 - RNA, 17 nt, Homo sapiens
ugguagagcugaggaca

SEQ ID NO: 794 - RNA, 17 nt, Homo sapiens
uguccucagcucuacca

SEQ ID NO: 795 - RNA, 23 nt, Homo sapiens
uugaauucuuggccuuaagugau

SEQ ID NO: 796 - RNA, 23 nt, Homo sapiens
aucacuuaaggccaagaauucaa

SEQ ID NO: 797 - RNA, 20 nt, Homo sapiens
gagcuuggucuguagcgguu

SEQ ID NO: 798 - RNA, 20 nt, Homo sapiens
aaccgcuacagaccaagcuc

SEQ ID NO: 799 - RNA, 20 nt, Homo sapiens
ggauccgagucacggcacca

SEQ ID NO: 800 - RNA, 20 nt, Homo sapiens
uggugccgugacucggaucc

SEQ ID NO: 801 - RNA, 17 nt, Homo sapiens
aggguguguguguuuuu

SEQ ID NO: 802 - RNA, 17 nt, Homo sapiens
aaaaacacacacacccu

SEQ ID NO: 803 - RNA, 17 nt, Homo sapiens
ccugguggcuuccuuuu

SEQ ID NO: 804 - RNA, 17 nt, Homo sapiens
aaaaggaagccaccagg

SEQ ID NO: 805 - RNA, 22 nt, Homo sapiens
ucacaagguauugacuggcgua

SEQ ID NO: 806 - RNA, 22 nt, Homo sapiens
uacgccagucaauaccuuguga

SEQ ID NO: 807 - RNA, 19 nt, Homo sapiens
agagguagguguggaagaa

SEQ ID NO: 808 - RNA, 19 nt, Homo sapiens
uucuuccacaccuaccucu

SEQ ID NO: 809 - RNA, 22 nt, Homo sapiens
ccaggaggcggaggagguggag

SEQ ID NO: 810 - RNA, 22 nt, Homo sapiens
cuccaccuccuccgccuccugg

SEQ ID NO: 811 - RNA, 22 nt, Homo sapiens
auagugguugugaauuuaccuu

SEQ ID NO: 812 - RNA, 22 nt, Homo sapiens
aagguaaauucacaaccacuau

SEQ ID NO: 813 - RNA, 23 nt, Homo sapiens
gauugagacuaguagggcuaggc

SEQ ID NO: 814 - RNA, 23 nt, Homo sapiens
gccuagcccuacuagucucaauc

SEQ ID NO: 815 - RNA, 23 nt, Homo sapiens
ugacacggaggguggcuugggaa

SEQ ID NO: 816 - RNA, 23 nt, Homo sapiens
uucccaagccacccuccguguca

SEQ ID NO: 817 - RNA, 17 nt, Homo sapiens
gagacugggguggggcc

SEQ ID NO: 818 - RNA, 17 nt, Homo sapiens
ggccccaccccagucuc

SEQ ID NO: 819 - RNA, 21 nt, Homo sapiens
aagguuuggauagaugcaaua

SEQ ID NO: 820 - RNA, 21 nt, Homo sapiens
uauugcaucuauccaaaccuu

SEQ ID NO: 821 - RNA, 22 nt, Homo sapiens
cucaaguagucugaccagggga

SEQ ID NO: 822 - RNA, 22 nt, Homo sapiens
uccccuggucagacuacuugag

SEQ ID NO: 823 - RNA, 18 nt, Homo sapiens
gggugcgggccggcgggg

SEQ ID NO: 824 - RNA, 18 nt, Homo sapiens
ccccgccggcccgcaccc

SEQ ID NO: 825 - RNA, 18 nt, Homo sapiens
agagcagaaggaugagau

SEQ ID NO: 826 - RNA, 18 nt, Homo sapiens
aucucauccuucugcucu

SEQ ID NO: 827 - RNA, 21 nt, Homo sapiens
uggcaaacguggaagccgaga

SEQ ID NO: 828 - RNA, 21 nt, Homo sapiens
ucucggcuuccacguuugcca

SEQ ID NO: 829 - RNA, 18 nt, Homo sapiens
ggugggggguguuguuuu

SEQ ID NO: 830 - RNA, 18 nt, Homo sapiens
aaaacaacaccccccacc

SEQ ID NO: 831 - RNA, 22 nt, Homo sapiens
cuagugcucuccguuacaagua

SEQ ID NO: 832 - RNA, 22 nt, Homo sapiens
uacuuguaacggagagcacuag

SEQ ID NO: 833 - RNA, 22 nt, Homo sapiens
caagggaccaagcauucauuau

SEQ ID NO: 834 - RNA, 22 nt, Homo sapiens
auaaugaaugcuuggucccuug

SEQ ID NO: 835 - RNA, 22 nt, Homo sapiens
caggaaggauuuagggacaggc

SEQ ID NO: 836 - RNA, 22 nt, Homo sapiens
gccugucccuaaauccuuccug

SEQ ID NO: 837 - RNA, 22 nt, Homo sapiens
cuauuaaggacauuugugauuc

SEQ ID NO: 838 - RNA, 22 nt, Homo sapiens
gaaucacaaauguccuuaauag

SEQ ID NO: 839 - RNA, 22 nt, Homo sapiens
auuaaggacauuugugauugau

SEQ ID NO: 840 - RNA, 22 nt, Homo sapiens
aucaaucacaaauguccuuaau

SEQ ID NO: 841 - RNA, 17 nt, Homo sapiens
gaggcugagcugaggag

SEQ ID NO: 842 - RNA, 17 nt, Homo sapiens
cuccucagcucagccuc

SEQ ID NO: 843 - RNA, 22 nt, Homo sapiens
cgcgcggccgugcucggagcag

SEQ ID NO: 844 - RNA, 22 nt, Homo sapiens
cugcuccgagcacggccgcgcg

SEQ ID NO: 845 - RNA, 21 nt, Homo sapiens
agccaaguggaaguuacuuua

SEQ ID NO: 846 - RNA, 21 nt, Homo sapiens
uaaaguaacuuccacuuggcu

SEQ ID NO: 847 - RNA, 17 nt, Homo sapiens
ggagugggcuggugguu

SEQ ID NO: 848 - RNA, 17 nt, Homo sapiens
aaccaccagcccacucc

SEQ ID NO: 849 - RNA, 22 nt, Homo sapiens
uuucuauuucucaguggggcuc

SEQ ID NO: 850 - RNA, 22 nt, Homo sapiens
gagccccacugagaaauagaaa

SEQ ID NO: 851 - RNA, 22 nt, Homo sapiens
aacccagugggcuauggaaaug

SEQ ID NO: 852 - RNA, 22 nt, Homo sapiens
cauuuccauagcccacuggguu

SEQ ID NO: 853 - RNA, 17 nt, Homo sapiens
gggguggucuguuguug

SEQ ID NO: 854 - RNA, 17 nt, Homo sapiens
caacaacagaccacccc

SEQ ID NO: 855 - RNA, 20 nt, Homo sapiens
aaaaggcgggagaagcccca

SEQ ID NO: 856 - RNA, 20 nt, Homo sapiens
uggggcuucucccgccuuuu

SEQ ID NO: 857 - RNA, 20 nt, Homo sapiens
uaacggccgcgguacccuaa

SEQ ID NO: 858 - RNA, 20 nt, Homo sapiens
uuaggguaccgcggccguua

SEQ ID NO: 859 - RNA, 17 nt, Homo sapiens
gcugggcgaggcuggca

SEQ ID NO: 860 - RNA, 17 nt, Homo sapiens
ugccagccucgcccagc

SEQ ID NO: 861 - RNA, 19 nt, Homo sapiens
agagcuggcugaagggcag

SEQ ID NO: 862 - RNA, 19 nt, Homo sapiens
cugcccuucagccagcucu

SEQ ID NO: 863 - RNA, 18 nt, Homo sapiens
agggggcgggcuccggcg

SEQ ID NO: 864 - RNA, 18 nt, Homo sapiens
cgccggagcccgcccccu

SEQ ID NO: 865 - RNA, 22 nt, Homo sapiens
ucugguaagagauuugggcaua

SEQ ID NO: 866 - RNA, 22 nt, Homo sapiens
uaugcccaaaucucuuaccaga

SEQ ID NO: 867 - RNA, 22 nt, Homo sapiens
aauguggacuggugugaccaaa

SEQ ID NO: 868 - RNA, 22 nt, Homo sapiens
uuuggucacaccaguccacauu

SEQ ID NO: 869 - RNA, 17 nt, Homo sapiens
ggggcugggcgcgcgcc

SEQ ID NO: 870 - RNA, 17 nt, Homo sapiens
ggcgcgcgcccagcccc

SEQ ID NO: 871 - RNA, 21 nt, Homo sapiens
agaaggccuuuccaucucugu

SEQ ID NO: 872 - RNA, 21 nt, Homo sapiens
acagagauggaaaggccuucu

SEQ ID NO: 873 - RNA, 22 nt, Homo sapiens
ccagacuguggcugaccagagg

SEQ ID NO: 874 - RNA, 22 nt, Homo sapiens
ccucuggucagccacagucugg

SEQ ID NO: 875 - RNA, 21 nt, Homo sapiens
aauguaaacaggcuuuuugcu

SEQ ID NO: 876 - RNA, 21 nt, Homo sapiens
agcaaaaagccuguuuacauu

SEQ ID NO: 877 - RNA, 22 nt, Homo sapiens
gaggaaacugaagcugagaggg

SEQ ID NO: 878 - RNA, 22 nt, Homo sapiens
cccucucagcuucaguuuccuc

SEQ ID NO: 879 - RNA, 17 nt, Homo sapiens
cuccgggacggcugggc

SEQ ID NO: 880 - RNA, 17 nt, Homo sapiens
gcccagccgucccggag

SEQ ID NO: 881 - RNA, 22 nt, Homo sapiens
ugggcuggcagggcaagugcug

SEQ ID NO: 882 - RNA, 22 nt, Homo sapiens
cagcacuugcccugccagccca

SEQ ID NO: 883 - RNA, 17 nt, Homo sapiens
aagacugagaggaggga

SEQ ID NO: 884 - RNA, 17 nt, Homo sapiens
ucccuccucucagucuu

SEQ ID NO: 885 - RNA, 17 nt, Homo sapiens
ugagguaguaguuucuu

SEQ ID NO: 886 - RNA, 17 nt, Homo sapiens
aagaaacuacuaccuca

SEQ ID NO: 887 - RNA, 21 nt, Homo sapiens
uaugugaccucggaugaauca

SEQ ID NO: 888 - RNA, 21 nt, Homo sapiens
ugauucauccgaggucacaua

SEQ ID NO: 889 - RNA, 22 nt, Homo sapiens
gcugaugaugauggugcugaag

SEQ ID NO: 890 - RNA, 22 nt, Homo sapiens
cuucagcaccaucaucaucagc

SEQ ID NO: 891 - RNA, 22 nt, Homo sapiens
uuuaagcaggaaauagaauuua

SEQ ID NO: 892 - RNA, 22 nt, Homo sapiens
uaaauucuauuuccugcuuaaa

SEQ ID NO: 893 - RNA, 22 nt, Homo sapiens
ugugacaauagagaugaacaug

SEQ ID NO: 894 - RNA, 22 nt, Homo sapiens
cauguucaucucuauugucaca

SEQ ID NO: 895 - RNA, 18 nt, Homo sapiens
aggcugggcugggacgga

SEQ ID NO: 896 - RNA, 18 nt, Homo sapiens
uccgucccagcccagccu

SEQ ID NO: 897 - RNA, 20 nt, Homo sapiens
aaauggguggucugaggcaa

SEQ ID NO: 898 - RNA, 20 nt, Homo sapiens
uugccucagaccacccauuu

SEQ ID NO: 899 - RNA, 20 nt, Homo sapiens
cuggguugggcugggcuggg

SEQ ID NO: 900 - RNA, 20 nt, Homo sapiens
cccagcccagcccaacccag

SEQ ID NO: 901 - RNA, 17 nt, Homo sapiens
gcggggcugggcgcgcg

SEQ ID NO: 902 - RNA, 17 nt, Homo sapiens
cgcgcgcccagccccgc

SEQ ID NO: 903 - RNA, 22 nt, Homo sapiens
acuaaaggauauagaagguuuu

SEQ ID NO: 904 - RNA, 22 nt, Homo sapiens
aaaaccuucuauauccuuuagu

SEQ ID NO: 905 - RNA, 22 nt, Homo sapiens
ugagggaguaggauguaugguu

SEQ ID NO: 906 - RNA, 22 nt, Homo sapiens
aaccauacauccuacucccuca

SEQ ID NO: 907 - RNA, 22 nt, Homo sapiens
gaagaacuguugcauuugcccu

SEQ ID NO: 908 - RNA, 22 nt, Homo sapiens
agggcaaaugcaacaguucuuc

SEQ ID NO: 909 - RNA, 22 nt, Homo sapiens
cagggccucacuguaucgccca

SEQ ID NO: 910 - RNA, 22 nt, Homo sapiens
ugggcgauacagugaggcccug

SEQ ID NO: 911 - RNA, 22 nt, Homo sapiens
agacugacggcuggaggcccau

SEQ ID NO: 912 - RNA, 22 nt, Homo sapiens
augggccuccagccgucagucu

SEQ ID NO: 913 - RNA, 18 nt, Homo sapiens
acaggcaggauuggggaa

SEQ ID NO: 914 - RNA, 18 nt, Homo sapiens
uuccccaauccugccugu

SEQ ID NO: 915 - RNA, 22 nt, Homo sapiens
aggacuggacucccggcagccc

SEQ ID NO: 916 - RNA, 22 nt, Homo sapiens
gggcugccgggaguccaguccu

SEQ ID NO: 917 - RNA, 17 nt, Homo sapiens
gggagaagggucggggc

SEQ ID NO: 918 - RNA, 17 nt, Homo sapiens
gccccgacccuucuccc

SEQ ID NO: 919 - RNA, 25 nt, Homo sapiens
aaauaugaugaaacucacagcugag

SEQ ID NO: 920 - RNA, 25 nt, Homo sapiens
cucagcugugaguuucaucauauuu

SEQ ID NO: 921 - RNA, 26 nt, Homo sapiens
gcucagggaugauaacugugcugaga

SEQ ID NO: 922 - RNA, 26 nt, Homo sapiens
ucucagcacaguuaucaucccugagc

SEQ ID NO: 923 - RNA, 18 nt, Homo sapiens
cagcagugcgcagggcug

SEQ ID NO: 924 - RNA, 18 nt, Homo sapiens
cagcccugcgcacugcug

SEQ ID NO: 925 - RNA, 22 nt, Homo sapiens
gcuaaggaaguccugugcucag

SEQ ID NO: 926 - RNA, 22 nt, Homo sapiens
cugagcacaggacuuccuuagc

SEQ ID NO: 927 - RNA, 21 nt, Homo sapiens
ugacucugccuguaggccggu

SEQ ID NO: 928 - RNA, 21 nt, Homo sapiens
accggccuacaggcagaguca

SEQ ID NO: 929 - RNA, 21 nt, Homo sapiens
gaccgagagggccucggcugu

SEQ ID NO: 930 - RNA, 21 nt, Homo sapiens
acagccgaggcccucucgguc

SEQ ID NO: 931 - RNA, 21 nt, Homo sapiens
ggggggaugugcaugcugguu

SEQ ID NO: 932 - RNA, 21 nt, Homo sapiens
aaccagcaugcacaucccccc

SEQ ID NO: 933 - RNA, 22 nt, Homo sapiens
uggucugcaaagagaugacugu

SEQ ID NO: 934 - RNA, 22 nt, Homo sapiens
acagucaucucuuugcagacca

SEQ ID NO: 935 - RNA, 22 nt, Homo sapiens
ucauuauauguaugaucuggac

SEQ ID NO: 936 - RNA, 22 nt, Homo sapiens
guccagaucauacauauaauga

SEQ ID NO: 937 - RNA, 18 nt, Homo sapiens
cccagcaggacgggagcg

SEQ ID NO: 938 - RNA, 18 nt, Homo sapiens
cgcucccguccugcuggg

SEQ ID NO: 939 - RNA, 17 nt, Homo sapiens
auggagaaggcuucuga

SEQ ID NO: 940 - RNA, 17 nt, Homo sapiens
ucagaagccuucuccau

SEQ ID NO: 941 - RNA, 17 nt, Homo sapiens
ccccggggagcccggcg

SEQ ID NO: 942 - RNA, 17 nt, Homo sapiens
cgccgggcuccccgggg

SEQ ID NO: 943 - RNA, 22 nt, Homo sapiens
uggaaggagguugccggacgcu

SEQ ID NO: 944 - RNA, 22 nt, Homo sapiens
agcguccggcaaccuccuucca

SEQ ID NO: 945 - RNA, 17 nt, Homo sapiens
ggauggaggaggggucu

SEQ ID NO: 946 - RNA, 17 nt, Homo sapiens
agaccccuccuccaucc

SEQ ID NO: 947 - RNA, 17 nt, Homo sapiens
guggaccuggcugggac

SEQ ID NO: 948 - RNA, 17 nt, Homo sapiens
gucccagccagguccac

SEQ ID NO: 949 - RNA, 21 nt, Homo sapiens
ucgugcauauaucuaccacau

SEQ ID NO: 950 - RNA, 21 nt, Homo sapiens
augugguagauauaugcacga

SEQ ID NO: 951 - RNA, 21 nt, Homo sapiens
ugugguagauauaugcacgau

SEQ ID NO: 952 - RNA, 21 nt, Homo sapiens
aucgugcauauaucuaccaca

SEQ ID NO: 953 - RNA, 22 nt, Homo sapiens
ugagccgagcugagcuuagcug

SEQ ID NO: 954 - RNA, 22 nt, Homo sapiens
cagcuaagcucagcucggcuca

SEQ ID NO: 955 - RNA, 22 nt, Homo sapiens
gagcuuggaugagcugggcuga

SEQ ID NO: 956 - RNA, 22 nt, Homo sapiens
ucagcccagcucauccaagcuc

SEQ ID NO: 957 - RNA, 22 nt, Homo sapiens
gcugaacugggcugagcugggc

SEQ ID NO: 958 - RNA, 22 nt, Homo sapiens
gcccagcucagcccaguucagc

SEQ ID NO: 959 - RNA, 21 nt, Homo sapiens
uuaguccugccuguagguuua

SEQ ID NO: 960 - RNA, 21 nt, Homo sapiens
uaaaccuacaggcaggacuaa

SEQ ID NO: 961 - RNA, 20 nt, Homo sapiens
uugggcugggcuggguuggg

SEQ ID NO: 962 - RNA, 20 nt, Homo sapiens
cccaacccagcccagcccaa

SEQ ID NO: 963 - RNA, 20 nt, Homo sapiens
uaggaugggggugagaggug

SEQ ID NO: 964 - RNA, 20 nt, Homo sapiens
caccucucacccccauccua

SEQ ID NO: 965 - RNA, 22 nt, Homo sapiens
aaaaguaauuguggauuuugcu

SEQ ID NO: 966 - RNA, 22 nt, Homo sapiens
agcaaaauccacaauuacuuuu

SEQ ID NO: 967 - RNA, 22 nt, Homo sapiens
caaaaaccggcaauuacuuuug

SEQ ID NO: 968 - RNA, 22 nt, Homo sapiens
caaaaguaauugccgguuuuug

SEQ ID NO: 969 - RNA, 22 nt, Homo sapiens
gaaaacgacaaugacuuuugca

SEQ ID NO: 970 - RNA, 22 nt, Homo sapiens
ugcaaaagucauugucguuuuc

SEQ ID NO: 971 - RNA, 21 nt, Homo sapiens
caaaaacugcaauuacuuuca

SEQ ID NO: 972 - RNA, 21 nt, Homo sapiens
ugaaaguaauugcaguuuuug

SEQ ID NO: 973 - RNA, 21 nt, Homo sapiens
aaagguaauugugguuucugc

SEQ ID NO: 974 - RNA, 21 nt, Homo sapiens
gcagaaaccacaauuaccuuu

SEQ ID NO: 975 - RNA, 22 nt, Homo sapiens
caaaaacugcaguuacuuuugc

SEQ ID NO: 976 - RNA, 22 nt, Homo sapiens
gcaaaaguaacugcaguuuuug

SEQ ID NO: 977 - RNA, 20 nt, Homo sapiens
aaaagugauugcaguguuug

SEQ ID NO: 978 - RNA, 20 nt, Homo sapiens
caaacacugcaaucacuuuu

SEQ ID NO: 979 - RNA, 22 nt, Homo sapiens
aaagguaauugcaguuuuuccc

SEQ ID NO: 980 - RNA, 22 nt, Homo sapiens
gggaaaaacugcaauuaccuuu

SEQ ID NO: 981 - RNA, 21 nt, Homo sapiens
uaaaaacugcaauuacuuuua

SEQ ID NO: 982 - RNA, 21 nt, Homo sapiens
uaaaaguaauugcaguuuuua

SEQ ID NO: 983 - RNA, 23 nt, Homo sapiens
ugcaaaaguaauugcaguuuuug

SEQ ID NO: 984 - RNA, 23 nt, Homo sapiens
caaaaacugcaauuacuuuugca

SEQ ID NO: 985 - RNA, 21 nt, Homo sapiens
aaaaguaacugcgguuuuuga

SEQ ID NO: 986 - RNA, 21 nt, Homo sapiens
ucaaaaaccgcaguuacuuuu

SEQ ID NO: 987 - RNA, 22 nt, Homo sapiens
aacggcaaugacuuuuguacca

SEQ ID NO: 988 - RNA, 22 nt, Homo sapiens
ugguacaaaagucauugccguu

SEQ ID NO: 989 - RNA, 22 nt, Homo sapiens
caaaaacugcaguuacuuuugu

SEQ ID NO: 990 - RNA, 22 nt, Homo sapiens
acaaaaguaacugcaguuuuug

SEQ ID NO: 991 - RNA, 22 nt, Homo sapiens
aaaaguaauugcgguuuuugcc

SEQ ID NO: 992 - RNA, 22 nt, Homo sapiens
ggcaaaaaccgcaauuacuuuu

SEQ ID NO: 993 - RNA, 20 nt, Homo sapiens
aaaaggcauugugguuuuug

SEQ ID NO: 994 - RNA, 20 nt, Homo sapiens
caaaaaccacaaugccuuuu

SEQ ID NO: 995 - RNA, 23 nt, Homo sapiens
cggcccgggcugcugcuguuccu

SEQ ID NO: 996 - RNA, 23 nt, Homo sapiens
aggaacagcagcagcccgggccg

SEQ ID NO: 997 - RNA, 20 nt, Homo sapiens
agagguauagggcaugggaa

SEQ ID NO: 998 - RNA, 20 nt, Homo sapiens
uucccaugcccuauaccucu

SEQ ID NO: 999 - RNA, 22 nt, Homo sapiens
uuccuaugcauauacuucuuug

SEQ ID NO: 1000 - RNA, 22 nt, Homo sapiens
caaagaaguauaugcauaggaa

SEQ ID NO: 1001 - RNA, 22 nt, Homo sapiens
aucauagaggaaaauccauguu

SEQ ID NO: 1002 - RNA, 22 nt, Homo sapiens
aacauggauuuuccucuaugau

SEQ ID NO: 1003 - RNA, 22 nt, Homo sapiens
cguggauauuccuucuauguuu

SEQ ID NO: 1004 - RNA, 22 nt, Homo sapiens
aaacauagaaggaauauccacg

SEQ ID NO: 1005 - RNA, 22 nt, Homo sapiens
ugaguauuacauggccaaucuc

SEQ ID NO: 1006 - RNA, 22 nt, Homo sapiens
gagauuggccauguaauacuca

SEQ ID NO: 1007 - RNA, 21 nt, Homo sapiens
cuuccgccccgccgggcgucg

SEQ ID NO: 1008 - RNA, 21 nt, Homo sapiens
cgacgcccggcggggcggaag

SEQ ID NO: 1009 - RNA, 22 nt, Homo sapiens
uagcuuaucagacugauguuga

SEQ ID NO: 1010 - RNA, 22 nt, Homo sapiens
ucaacaucagucugauaagcua

SEQ ID NO: 1011 - RNA, 22 nt, Homo sapiens
cacuagauugugagcuccugga

SEQ ID NO: 1012 - RNA, 22 nt, Homo sapiens
uccaggagcucacaaucuagug

SEQ ID NO: 1013 - RNA, 22 nt, Homo sapiens
aaggagcucacagucuauugag

SEQ ID NO: 1014 - RNA, 22 nt, Homo sapiens
cucaauagacugugagcuccuu

SEQ ID NO: 1015 - RNA, 22 nt, Homo sapiens
uacgucaucguugucaucguca

SEQ ID NO: 1016 - RNA, 22 nt, Homo sapiens
ugacgaugacaacgaugacgua

SEQ ID NO: 1017 - RNA, 22 nt, Homo sapiens
cacgcucaugcacacacccaca

SEQ ID NO: 1018 - RNA, 22 nt, Homo sapiens
ugugggugugugcaugagcgug

SEQ ID NO: 1019 - RNA, 21 nt, Homo sapiens
caacaccagucgaugggcugu

SEQ ID NO: 1020 - RNA, 21 nt, Homo sapiens
acagcccaucgacugguguug

SEQ ID NO: 1021 - RNA, 22 nt, Homo sapiens
uucaccaccuucuccacccagc

SEQ ID NO: 1022 - RNA, 22 nt, Homo sapiens
gcuggguggagaagguggugaa

SEQ ID NO: 1023 - RNA, 23 nt, Homo sapiens
cggguagagagggcagugggagg

SEQ ID NO: 1024 - RNA, 23 nt, Homo sapiens
ccucccacugcccucucuacccg

SEQ ID NO: 1025 - RNA, 18 nt, Homo sapiens
aauccuugcuaccugggu

SEQ ID NO: 1026 - RNA, 18 nt, Homo sapiens
acccagguagcaaggauu

SEQ ID NO: 1027 - RNA, 22 nt, Homo sapiens
caauuuagugugugugauauuu

SEQ ID NO: 1028 - RNA, 22 nt, Homo sapiens
aaauaucacacacacuaaauug

SEQ ID NO: 1029 - RNA, 22 nt, Homo sapiens
uauugcacauuacuaaguugca

SEQ ID NO: 1030 - RNA, 22 nt, Homo sapiens
ugcaacuuaguaaugugcaaua

SEQ ID NO: 1031 - RNA, 22 nt, Homo sapiens
ccuauucuugauuacuuguuuc

SEQ ID NO: 1032 - RNA, 22 nt, Homo sapiens
gaaacaaguaaucaagaauagg

SEQ ID NO: 1033 - RNA, 22 nt, Homo sapiens
uucaaguaauccaggauaggcu

SEQ ID NO: 1034 - RNA, 22 nt, Homo sapiens
agccuauccuggauuacuugaa

SEQ ID NO: 1035 - RNA, 23 nt, Homo sapiens
ccaguuaccgcuuccgcuaccgc

SEQ ID NO: 1036 - RNA, 23 nt, Homo sapiens
gcgguagcggaagcgguaacugg

SEQ ID NO: 1037 - RNA, 21 nt, Homo sapiens
gauuucaguggagugaaguuc

SEQ ID NO: 1038 - RNA, 21 nt, Homo sapiens
gaacuucacuccacugaaauc

SEQ ID NO: 1039 - RNA, 22 nt, Homo sapiens
uccuucauuccaccggagucug

SEQ ID NO: 1040 - RNA, 22 nt, Homo sapiens
cagacuccgguggaaugaagga

SEQ ID NO: 1041 - RNA, 23 nt, Homo sapiens
aaaauggugcccuagugacuaca

SEQ ID NO: 1042 - RNA, 23 nt, Homo sapiens
uguagucacuagggcaccauuuu

SEQ ID NO: 1043 - RNA, 21 nt, Homo sapiens
caagucacuagugguuccguu

SEQ ID NO: 1044 - RNA, 21 nt, Homo sapiens
aacggaaccacuagugacuug

SEQ ID NO: 1045 - RNA, 22 nt, Homo sapiens
ccaguauuaacugugcugcuga

SEQ ID NO: 1046 - RNA, 22 nt, Homo sapiens
ucagcagcacaguuaauacugg

SEQ ID NO: 1047 - RNA, 23 nt, Homo sapiens
ucccccaggugugauucugauuu

SEQ ID NO: 1048 - RNA, 23 nt, Homo sapiens
aaaucagaaucacaccuggggga

SEQ ID NO: 1049 - RNA, 22 nt, Homo sapiens
aaaagcuggguugagagggcga

SEQ ID NO: 1050 - RNA, 22 nt, Homo sapiens
ucgcccucucaacccagcuuuu

SEQ ID NO: 1051 - RNA, 22 nt, Homo sapiens
uggacggagaacugauaagggu

SEQ ID NO: 1052 - RNA, 22 nt, Homo sapiens
acccuuaucaguucuccgucca

SEQ ID NO: 1053 - RNA, 22 nt, Homo sapiens
uggugggccgcagaacaugugc

SEQ ID NO: 1054 - RNA, 22 nt, Homo sapiens
gcacauguucugcggcccacca

SEQ ID NO: 1055 - RNA, 22 nt, Homo sapiens
agugccugcuaugugccaggca

SEQ ID NO: 1056 - RNA, 22 nt, Homo sapiens
ugccuggcacauagcaggcacu

SEQ ID NO: 1057 - RNA, 22 nt, Homo sapiens
cuuggcaccuagcaagcacuca

SEQ ID NO: 1058 - RNA, 22 nt, Homo sapiens
ugagugcuugcuaggugccaag

SEQ ID NO: 1059 - RNA, 23 nt, Homo sapiens
uuauugcuuaagaauacgcguag

SEQ ID NO: 1060 - RNA, 23 nt, Homo sapiens
cuacgcguauucuuaagcaauaa

SEQ ID NO: 1061 - RNA, 22 nt, Homo sapiens
uugcauagucacaaaagugauc

SEQ ID NO: 1062 - RNA, 22 nt, Homo sapiens
gaucacuuuugugacuaugcaa

SEQ ID NO: 1063 - RNA, 22 nt, Homo sapiens
gugaauuaccgaagggccauaa

SEQ ID NO: 1064 - RNA, 22 nt, Homo sapiens
uuauggcccuucgguaauucac

SEQ ID NO: 1065 - RNA, 22 nt, Homo sapiens
uauggcacugguagaauucacu

SEQ ID NO: 1066 - RNA, 22 nt, Homo sapiens
agugaauucuaccagugccaua

SEQ ID NO: 1067 - RNA, 22 nt, Homo sapiens
ugauauguuugauauauuaggu

SEQ ID NO: 1068 - RNA, 22 nt, Homo sapiens
accuaauauaucaaacauauca

SEQ ID NO: 1069 - RNA, 21 nt, Homo sapiens
ugauauguuugauauuggguu

SEQ ID NO: 1070 - RNA, 21 nt, Homo sapiens
aacccaauaucaaacauauca

SEQ ID NO: 1071 - RNA, 18 nt, Homo sapiens
agcaggugcggggcggcg

SEQ ID NO: 1072 - RNA, 18 nt, Homo sapiens
cgccgccccgcaccugcu

SEQ ID NO: 1073 - RNA, 21 nt, Homo sapiens
cagugcaaguguagaugccga

SEQ ID NO: 1074 - RNA, 21 nt, Homo sapiens
ucggcaucuacacuugcacug

SEQ ID NO: 1075 - RNA, 22 nt, Homo sapiens
uauguaauaugguccacaucuu

SEQ ID NO: 1076 - RNA, 22 nt, Homo sapiens
aagauguggaccauauuacaua

SEQ ID NO: 1077 - RNA, 21 nt, Homo sapiens
aauauaacacagauggccugu

SEQ ID NO: 1078 - RNA, 21 nt, Homo sapiens
acaggccaucuguguuauauu

SEQ ID NO: 1079 - RNA, 22 nt, Homo sapiens
aucgggaaugucguguccgccc

SEQ ID NO: 1080 - RNA, 22 nt, Homo sapiens
gggcggacacgacauucccgau

SEQ ID NO: 1081 - RNA, 23 nt, Homo sapiens
aaugacacgaucacucccguuga

SEQ ID NO: 1082 - RNA, 23 nt, Homo sapiens
ucaacgggagugaucgugucauu

SEQ ID NO: 1083 - RNA, 22 nt, Homo sapiens
uacucaggagaguggcaaucac

SEQ ID NO: 1084 - RNA, 22 nt, Homo sapiens
gugauugccacucuccugagua

SEQ ID NO: 1085 - RNA, 23 nt, Homo sapiens
uggaagacuagugauuuuguugu

SEQ ID NO: 1086 - RNA, 23 nt, Homo sapiens
acaacaaaaucacuagucuucca

SEQ ID NO: 1087 - RNA, 22 nt, Homo sapiens
auaaagcuagauaaccgaaagu

SEQ ID NO: 1088 - RNA, 22 nt, Homo sapiens
acuuucgguuaucuagcuuuau

SEQ ID NO: 1089 - RNA, 23 nt, Homo sapiens
ucuuugguuaucuagcuguauga

SEQ ID NO: 1090 - RNA, 23 nt, Homo sapiens
ucauacagcuagauaaccaaaga

SEQ ID NO: 1091 - RNA, 22 nt, Homo sapiens
acaggugagguucuugggagcc

SEQ ID NO: 1092 - RNA, 22 nt, Homo sapiens
ggcucccaagaaccucaccugu

SEQ ID NO: 1093 - RNA, 24 nt, Homo sapiens
ucccugagacccuuuaaccuguga

SEQ ID NO: 1094 - RNA, 24 nt, Homo sapiens
ucacagguuaaagggucucaggga

SEQ ID NO: 1095 - RNA, 22 nt, Homo sapiens
caacaaaucccagucuaccuaa

SEQ ID NO: 1096 - RNA, 22 nt, Homo sapiens
uuagguagacugggauuuguug

SEQ ID NO: 1097 - RNA, 22 nt, Homo sapiens
cguguucacagcggaccuugau

SEQ ID NO: 1098 - RNA, 22 nt, Homo sapiens
aucaagguccgcugugaacacg

SEQ ID NO: 1099 - RNA, 20 nt, Homo sapiens
uaaggcacgcggugaaugcc

SEQ ID NO: 1100 - RNA, 20 nt, Homo sapiens
ggcauucaccgcgugccuua

SEQ ID NO: 1101 - RNA, 22 nt, Homo sapiens
aacacaccugguuaaccucuuu

SEQ ID NO: 1102 - RNA, 22 nt, Homo sapiens
aaagagguuaaccagguguguu

SEQ ID NO: 1103 - RNA, 22 nt, Homo sapiens
uaacagucuacagccauggucg

SEQ ID NO: 1104 - RNA, 22 nt, Homo sapiens
cgaccauggcuguagacuguua

SEQ ID NO: 1105 - RNA, 22 nt, Homo sapiens
accguggcuuucgauuguuacu

SEQ ID NO: 1106 - RNA, 22 nt, Homo sapiens
aguaacaaucgaaagccacggu

SEQ ID NO: 1107 - RNA, 21 nt, Homo sapiens
uaacagucuccagucacggcc

SEQ ID NO: 1108 - RNA, 21 nt, Homo sapiens
ggccgugacuggagacuguua

SEQ ID NO: 1109 - RNA, 23 nt, Homo sapiens
accuuggcucuagacugcuuacu

SEQ ID NO: 1110 - RNA, 23 nt, Homo sapiens
aguaagcagucuagagccaaggu

SEQ ID NO: 1111 - RNA, 23 nt, Homo sapiens
ucucacacagaaaucgcacccgu

SEQ ID NO: 1112 - RNA, 23 nt, Homo sapiens
acgggugcgauuucugugugaga

SEQ ID NO: 1113 - RNA, 22 nt, Homo sapiens
ugguugaccauagaacaugcgc

SEQ ID NO: 1114 - RNA, 22 nt, Homo sapiens
gcgcauguucuauggucaacca

SEQ ID NO: 1115 - RNA, 23 nt, Homo sapiens
caguaacaaagauucauccuugu

SEQ ID NO: 1116 - RNA, 23 nt, Homo sapiens
acaaggaugaaucuuuguuacug

SEQ ID NO: 1117 - RNA, 22 nt, Homo sapiens
agaguugagucuggacgucccg

SEQ ID NO: 1118 - RNA, 22 nt, Homo sapiens
cgggacguccagacucaacucu

SEQ ID NO: 1119 - RNA, 22 nt, Homo sapiens
agaauuguggcuggacaucugu

SEQ ID NO: 1120 - RNA, 22 nt, Homo sapiens
acagauguccagccacaauucu

SEQ ID NO: 1121 - RNA, 21 nt, Homo sapiens
ugauuguccaaacgcaauucu

SEQ ID NO: 1122 - RNA, 21 nt, Homo sapiens
agaauugcguuuggacaauca

SEQ ID NO: 1123 - RNA, 22 nt, Homo sapiens
uauagggauuggagccguggcg

SEQ ID NO: 1124 - RNA, 22 nt, Homo sapiens
cgccacggcuccaaucccuaua

SEQ ID NO: 1125 - RNA, 23 nt, Homo sapiens
uauggcuuuuuauuccuauguga

SEQ ID NO: 1126 - RNA, 23 nt, Homo sapiens
ucacauaggaauaaaaagccaua

SEQ ID NO: 1127 - RNA, 22 nt, Homo sapiens
auguagggcuaaaagccauggg

SEQ ID NO: 1128 - RNA, 22 nt, Homo sapiens
cccauggcuuuuagcccuacau

SEQ ID NO: 1129 - RNA, 23 nt, Homo sapiens
uauggcuuuucauuccuauguga

SEQ ID NO: 1130 - RNA, 23 nt, Homo sapiens
ucacauaggaaugaaaagccaua

SEQ ID NO: 1131 - RNA, 22 nt, Homo sapiens
aaccaucgaccguugaguggac

SEQ ID NO: 1132 - RNA, 22 nt, Homo sapiens
guccacucaacggucgaugguu

SEQ ID NO: 1133 - RNA, 22 nt, Homo sapiens
aacauucaaccugucggugagu

SEQ ID NO: 1134 - RNA, 22 nt, Homo sapiens
acucaccgacagguugaauguu

SEQ ID NO: 1135 - RNA, 25 nt, Homo sapiens
cuuccagacgcuccgccccacgucg

SEQ ID NO: 1136 - RNA, 25 nt, Homo sapiens
cgacguggggcggagcgucuggaag

SEQ ID NO: 1137 - RNA, 24 nt, Homo sapiens
aacaacaaaaucacuagucuucca

SEQ ID NO: 1138 - RNA, 24 nt, Homo sapiens
uggaagacuagugauuuuguuguu

SEQ ID NO: 1139 - RNA, 22 nt, Homo sapiens
agguagacugggauuuguuguu

SEQ ID NO: 1140 - RNA, 22 nt, Homo sapiens
aacaacaaaucccagucuaccu

SEQ ID NO: 1141 - RNA, 22 nt, Homo sapiens
aaacaccauugucacacuccac

SEQ ID NO: 1142 - RNA, 22 nt, Homo sapiens
guggagugugacaaugguguuu

SEQ ID NO: 1143 - RNA, 23 nt, Homo sapiens
uuuagugugauaauggcguuuga

SEQ ID NO: 1144 - RNA, 23 nt, Homo sapiens
ucaaacgccauuaucacacuaaa

SEQ ID NO: 1145 - RNA, 22 nt, Homo sapiens
uauggaaagacuuugccacucu

SEQ ID NO: 1146 - RNA, 22 nt, Homo sapiens
agaguggcaaagucuuuccaua

SEQ ID NO: 1147 - RNA, 21 nt, Homo sapiens
aguggcaaagucuuuccauau

SEQ ID NO: 1148 - RNA, 21 nt, Homo sapiens
auauggaaagacuuugccacu

SEQ ID NO: 1149 - RNA, 22 nt, Homo sapiens
cagcccggaucccagcccacuu

SEQ ID NO: 1150 - RNA, 22 nt, Homo sapiens
aagugggcugggauccgggcug

SEQ ID NO: 1151 - RNA, 20 nt, Homo sapiens
guggguuggggcgggcucug

SEQ ID NO: 1152 - RNA, 20 nt, Homo sapiens
cagagcccgccccaacccac

SEQ ID NO: 1153 - RNA, 23 nt, Homo sapiens
uucgggcuggccugcugcuccgg

SEQ ID NO: 1154 - RNA, 23 nt, Homo sapiens
ccggagcagcaggccagcccgaa

SEQ ID NO: 1155 - RNA, 21 nt, Homo sapiens
ugugcagcaggccaaccgaga

SEQ ID NO: 1156 - RNA, 21 nt, Homo sapiens
ucucgguuggccugcugcaca

SEQ ID NO: 1157 - RNA, 22 nt, Homo sapiens
cagggcaggaagaaguggacaa

SEQ ID NO: 1158 - RNA, 22 nt, Homo sapiens
uuguccacuucuuccugcccug

SEQ ID NO: 1159 - RNA, 22 nt, Homo sapiens
guccacuucugccugcccugcc

SEQ ID NO: 1160 - RNA, 22 nt, Homo sapiens
ggcagggcaggcagaaguggac

SEQ ID NO: 1161 - RNA, 22 nt, Homo sapiens
uuuggacagaaaacacgcaggu

SEQ ID NO: 1162 - RNA, 22 nt, Homo sapiens
accugcguguuuucuguccaaa

SEQ ID NO: 1163 - RNA, 20 nt, Homo sapiens
ccugcguguuuucuguccaa

SEQ ID NO: 1164 - RNA, 20 nt, Homo sapiens
uuggacagaaaacacgcagg

SEQ ID NO: 1165 - RNA, 22 nt, Homo sapiens
ugccgcccucucgcugcucuag

SEQ ID NO: 1166 - RNA, 22 nt, Homo sapiens
cuagagcagcgagagggcggca

SEQ ID NO: 1167 - RNA, 23 nt, Homo sapiens
gagggcagcguggguguggcgga

SEQ ID NO: 1168 - RNA, 23 nt, Homo sapiens
uccgccacacccacgcugcccuc

SEQ ID NO: 1169 - RNA, 22 nt, Homo sapiens
aggagcuagccaggcauaugca

SEQ ID NO: 1170 - RNA, 22 nt, Homo sapiens
ugcauaugccuggcuagcuccu

SEQ ID NO: 1171 - RNA, 20 nt, Homo sapiens
auaugccuggcuagcuccuc

SEQ ID NO: 1172 - RNA, 20 nt, Homo sapiens
gaggagcuagccaggcauau

SEQ ID NO: 1173 - RNA, 19 nt, Homo sapiens
cggcgcgaccggcccgggg

SEQ ID NO: 1174 - RNA, 19 nt, Homo sapiens
ccccgggccggucgcgccg

SEQ ID NO: 1175 - RNA, 21 nt, Homo sapiens
ucuugaagucagaacccgcaa

SEQ ID NO: 1176 - RNA, 21 nt, Homo sapiens
uugcggguucugacuucaaga

SEQ ID NO: 1177 - RNA, 22 nt, Homo sapiens
aacucguguucaaagccuuuag

SEQ ID NO: 1178 - RNA, 22 nt, Homo sapiens
cuaaaggcuuugaacacgaguu

SEQ ID NO: 1179 - RNA, 23 nt, Homo sapiens
ccuggacaccgcucagccggccg

SEQ ID NO: 1180 - RNA, 23 nt, Homo sapiens
cggccggcugagcgguguccagg

SEQ ID NO: 1181 - RNA, 21 nt, Homo sapiens
acucggcugcgguggacaagu

SEQ ID NO: 1182 - RNA, 21 nt, Homo sapiens
acuuguccaccgcagccgagu

SEQ ID NO: 1183 - RNA, 20 nt, Homo sapiens
ucacucucaccuugcuuugc

SEQ ID NO: 1184 - RNA, 20 nt, Homo sapiens
gcaaagcaaggugagaguga

SEQ ID NO: 1185 - RNA, 22 nt, Homo sapiens
uugcuaaguaggcugagauuga

SEQ ID NO: 1186 - RNA, 22 nt, Homo sapiens
ucaaucucagccuacuuagcaa

SEQ ID NO: 1187 - RNA, 22 nt, Homo sapiens
cacccccuguuuccuggcccac

SEQ ID NO: 1188 - RNA, 22 nt, Homo sapiens
gugggccaggaaacagggggug

SEQ ID NO: 1189 - RNA, 23 nt, Homo sapiens
ugggccagggagcagcugguggg

SEQ ID NO: 1190 - RNA, 23 nt, Homo sapiens
cccaccagcugcucccuggccca

SEQ ID NO: 1191 - RNA, 24 nt, Homo sapiens
ugcccaugccauacuuuugccuca

SEQ ID NO: 1192 - RNA, 24 nt, Homo sapiens
ugaggcaaaaguauggcaugggca

SEQ ID NO: 1193 - RNA, 22 nt, Homo sapiens
auggcaucguccccugguggcu

SEQ ID NO: 1194 - RNA, 22 nt, Homo sapiens
agccaccaggggacgaugccau

SEQ ID NO: 1195 - RNA, 22 nt, Homo sapiens
gacacaugaccauaaaugcuaa

SEQ ID NO: 1196 - RNA, 22 nt, Homo sapiens
uuagcauuuauggucauguguc

SEQ ID NO: 1197 - RNA, 23 nt, Homo sapiens
uggagagagaaaagagacagaag

SEQ ID NO: 1198 - RNA, 23 nt, Homo sapiens
cuucugucucuuuucucucucca

SEQ ID NO: 1199 - RNA, 22 nt, Homo sapiens
agacaguaguucuugccugguu

SEQ ID NO: 1200 - RNA, 22 nt, Homo sapiens
aaccaggcaagaacuacugucu

SEQ ID NO: 1201 - RNA, 19 nt, Homo sapiens
accaggcaagaaauauugu

SEQ ID NO: 1202 - RNA, 19 nt, Homo sapiens
acaauauuucuugccuggu

SEQ ID NO: 1203 - RNA, 21 nt, Homo sapiens
auugucccucucccuucccag

SEQ ID NO: 1204 - RNA, 21 nt, Homo sapiens
cugggaagggagagggacaau

SEQ ID NO: 1205 - RNA, 22 nt, Homo sapiens
acugggaagaggagcugaggga

SEQ ID NO: 1206 - RNA, 22 nt, Homo sapiens
ucccucagcuccucuucccagu

SEQ ID NO: 1207 - RNA, 23 nt, Homo sapiens
gaagauggugcugugcugaggaa

SEQ ID NO: 1208 - RNA, 23 nt, Homo sapiens
uuccucagcacagcaccaucuuc

SEQ ID NO: 1209 - RNA, 20 nt, Homo sapiens
ugugggacugcaaaugggag

SEQ ID NO: 1210 - RNA, 20 nt, Homo sapiens
cucccauuugcagucccaca

SEQ ID NO: 1211 - RNA, 21 nt, Homo sapiens
ucugaggccugccucucccca

SEQ ID NO: 1212 - RNA, 21 nt, Homo sapiens
uggggagaggcaggccucaga

SEQ ID NO: 1213 - RNA, 24 nt, Homo sapiens
ugggcgaggggugggcucucagag

SEQ ID NO: 1214 - RNA, 24 nt, Homo sapiens
cucugagagcccaccccucgccca

SEQ ID NO: 1215 - RNA, 21 nt, Homo sapiens
agguagaaugaggccugacau

SEQ ID NO: 1216 - RNA, 21 nt, Homo sapiens
augucaggccucauucuaccu

SEQ ID NO: 1217 - RNA, 19 nt, Homo sapiens
ucaggccucuuucuaccuu

SEQ ID NO: 1218 - RNA, 19 nt, Homo sapiens
aagguagaaagaggccuga

SEQ ID NO: 1219 - RNA, 20 nt, Homo sapiens
cggggugggugaggucgggc

SEQ ID NO: 1220 - RNA, 20 nt, Homo sapiens
gcccgaccucacccaccccg

SEQ ID NO: 1221 - RNA, 22 nt, Homo sapiens
guucuguuaacccauccccuca

SEQ ID NO: 1222 - RNA, 22 nt, Homo sapiens
ugaggggauggguuaacagaac

SEQ ID NO: 1223 - RNA, 22 nt, Homo sapiens
aggggacugguuaauagaacua

SEQ ID NO: 1224 - RNA, 22 nt, Homo sapiens
uaguucuauuaaccaguccccu

SEQ ID NO: 1225 - RNA, 23 nt, Homo sapiens
uggaguuaaggguugcuuggaga

SEQ ID NO: 1226 - RNA, 23 nt, Homo sapiens
ucuccaagcaacccuuaacucca

SEQ ID NO: 1227 - RNA, 22 nt, Homo sapiens
ucucugagcaaggcuuaacacc

SEQ ID NO: 1228 - RNA, 22 nt, Homo sapiens
gguguuaagccuugcucagaga

SEQ ID NO: 1229 - RNA, 22 nt, Homo sapiens
ugugggaucuggaggcaucugg

SEQ ID NO: 1230 - RNA, 22 nt, Homo sapiens
ccagaugccuccagaucccaca

SEQ ID NO: 1231 - RNA, 21 nt, Homo sapiens
acccucgucagguccccgggg

SEQ ID NO: 1232 - RNA, 21 nt, Homo sapiens
ccccggggaccugacgagggu

SEQ ID NO: 1233 - RNA, 22 nt, Homo sapiens
caccggggauggcagagggucg

SEQ ID NO: 1234 - RNA, 22 nt, Homo sapiens
cgacccucugccauccccggug

SEQ ID NO: 1235 - RNA, 23 nt, Homo sapiens
ugggcugagggcaggaggccugu

SEQ ID NO: 1236 - RNA, 23 nt, Homo sapiens
acaggccuccugcccucagccca

SEQ ID NO: 1237 - RNA, 23 nt, Homo sapiens
aauguggaaguggucugaggcau

SEQ ID NO: 1238 - RNA, 23 nt, Homo sapiens
augccucagaccacuuccacauu

SEQ ID NO: 1239 - RNA, 23 nt, Homo sapiens
gugaguguggauccuggaggaau

SEQ ID NO: 1240 - RNA, 23 nt, Homo sapiens
auuccuccaggauccacacucac

SEQ ID NO: 1241 - RNA, 22 nt, Homo sapiens
uuucuucuuagacauggcaacg

SEQ ID NO: 1242 - RNA, 22 nt, Homo sapiens
cguugccaugucuaagaagaaa

SEQ ID NO: 1243 - RNA, 22 nt, Homo sapiens
cugccaugucuaagaagaaaac

SEQ ID NO: 1244 - RNA, 22 nt, Homo sapiens
guuuucuucuuagacauggcag

SEQ ID NO: 1245 - RNA, 22 nt, Homo sapiens
uuucuucuuagacauggcagcu

SEQ ID NO: 1246 - RNA, 22 nt, Homo sapiens
agcugccaugucuaagaagaaa

SEQ ID NO: 1247 - RNA, 19 nt, Homo sapiens
uugccaugucuaagaagaa

SEQ ID NO: 1248 - RNA, 19 nt, Homo sapiens
uucuucuuagacauggcaa

SEQ ID NO: 1249 - RNA, 23 nt, Homo sapiens
ugcagcucugguggaaaauggag

SEQ ID NO: 1250 - RNA, 23 nt, Homo sapiens
cuccauuuuccaccagagcugca

SEQ ID NO: 1251 - RNA, 22 nt, Homo sapiens
caggauccacagagcuagucca

SEQ ID NO: 1252 - RNA, 22 nt, Homo sapiens
uggacuagcucuguggauccug

SEQ ID NO: 1253 - RNA, 22 nt, Homo sapiens
aacuagcucuguggauccugac

SEQ ID NO: 1254 - RNA, 22 nt, Homo sapiens
gucaggauccacagagcuaguu

SEQ ID NO: 1255 - RNA, 22 nt, Homo sapiens
aaagauggacaauuggcuaaau

SEQ ID NO: 1256 - RNA, 22 nt, Homo sapiens
auuuagccaauuguccaucuuu

SEQ ID NO: 1257 - RNA, 24 nt, Homo sapiens
agcugagcuccauggacgugcagu

SEQ ID NO: 1258 - RNA, 24 nt, Homo sapiens
acugcacguccauggagcucagcu

SEQ ID NO: 1259 - RNA, 22 nt, Homo sapiens
cuuccggucugugagccccguc

SEQ ID NO: 1260 - RNA, 22 nt, Homo sapiens
gacggggcucacagaccggaag

SEQ ID NO: 1261 - RNA, 22 nt, Homo sapiens
uggggugcccacuccgcaaguu

SEQ ID NO: 1262 - RNA, 22 nt, Homo sapiens
aacuugcggagugggcacccca

SEQ ID NO: 1263 - RNA, 26 nt, Homo sapiens
cucggccgcggcgcguagcccccgcc

SEQ ID NO: 1264 - RNA, 26 nt, Homo sapiens
ggcgggggcuacgcgccgcggccgag

SEQ ID NO: 1265 - RNA, 23 nt, Homo sapiens
cugggggacgcgugagcgcgagc

SEQ ID NO: 1266 - RNA, 23 nt, Homo sapiens
gcucgcgcucacgcgucccccag

SEQ ID NO: 1267 - RNA, 21 nt, Homo sapiens
cauacaaucugacauguauuu

SEQ ID NO: 1268 - RNA, 21 nt, Homo sapiens
aaauacaugucagauuguaug

SEQ ID NO: 1269 - RNA, 21 nt, Homo sapiens
auacaugucagauuguaugcc

SEQ ID NO: 1270 - RNA, 21 nt, Homo sapiens
ggcauacaaucugacauguau

SEQ ID NO: 1271 - RNA, 21 nt, Homo sapiens
ucccuccuucuguccccacag

SEQ ID NO: 1272 - RNA, 21 nt, Homo sapiens
cuguggggacagaaggaggga

SEQ ID NO: 1273 - RNA, 22 nt, Homo sapiens
acuggggagcagaaggagaacc

SEQ ID NO: 1274 - RNA, 22 nt, Homo sapiens
gguucuccuucugcuccccagu

SEQ ID NO: 1275 - RNA, 23 nt, Homo sapiens
gaaaauccuuuuuguuuuuccag

SEQ ID NO: 1276 - RNA, 23 nt, Homo sapiens
cuggaaaaacaaaaaggauuuuc

SEQ ID NO: 1277 - RNA, 23 nt, Homo sapiens
agggaaaaaaaaaaggauuuguc

SEQ ID NO: 1278 - RNA, 23 nt, Homo sapiens
gacaaauccuuuuuuuuuucccu

SEQ ID NO: 1279 - RNA, 22 nt, Homo sapiens
uguguccgggaaguggaggagg

SEQ ID NO: 1280 - RNA, 22 nt, Homo sapiens
ccuccuccacuucccggacaca

SEQ ID NO: 1281 - RNA, 22 nt, Homo sapiens
ugaaguuacaucauggucgcuu

SEQ ID NO: 1282 - RNA, 22 nt, Homo sapiens
aagcgaccaugauguaacuuca

SEQ ID NO: 1283 - RNA, 22 nt, Homo sapiens
aagcgaccaugauguaacuuca

SEQ ID NO: 1284 - RNA, 22 nt, Homo sapiens
ugaaguuacaucauggucgcuu

SEQ ID NO: 1285 - RNA, 21 nt, Homo sapiens
uuagugcauagucuuuggucu

SEQ ID NO: 1286 - RNA, 21 nt, Homo sapiens
agaccaaagacuaugcacuaa

SEQ ID NO: 1287 - RNA, 22 nt, Homo sapiens
accgaagacugugcgcuaaucu

SEQ ID NO: 1288 - RNA, 22 nt, Homo sapiens
agauuagcgcacagucuucggu

SEQ ID NO: 1289 - RNA, 21 nt, Homo sapiens
uuacacagcuggacagaggca

SEQ ID NO: 1290 - RNA, 21 nt, Homo sapiens
ugccucuguccagcuguguaa

SEQ ID NO: 1291 - RNA, 22 nt, Homo sapiens
uccaggcaggagccggacugga

SEQ ID NO: 1292 - RNA, 22 nt, Homo sapiens
uccaguccggcuccugccugga

SEQ ID NO: 1293 - RNA, 21 nt, Homo sapiens
cugggcucgggacgcgcggcu

SEQ ID NO: 1294 - RNA, 21 nt, Homo sapiens
agccgcgcgucccgagcccag

SEQ ID NO: 1295 - RNA, 22 nt, Homo sapiens
ggggcugugauugaccagcagg

SEQ ID NO: 1296 - RNA, 22 nt, Homo sapiens
ccugcuggucaaucacagcccc

SEQ ID NO: 1297 - RNA, 22 nt, Homo sapiens
cacuguuucaccacuggcucuu

SEQ ID NO: 1298 - RNA, 22 nt, Homo sapiens
aagagccaguggugaaacagug

SEQ ID NO: 1299 - RNA, 21 nt, Homo sapiens
gagccaguggugagacaguga

SEQ ID NO: 1300 - RNA, 21 nt, Homo sapiens
ucacugucucaccacuggcuc

SEQ ID NO: 1301 - RNA, 22 nt, Homo sapiens
aagguauuguucagacuuauga

SEQ ID NO: 1302 - RNA, 22 nt, Homo sapiens
ucauaagucugaacaauaccuu

SEQ ID NO: 1303 - RNA, 22 nt, Homo sapiens
ucugugauagagauucuuugcu

SEQ ID NO: 1304 - RNA, 22 nt, Homo sapiens
agcaaagaaucucuaucacaga

SEQ ID NO: 1305 - RNA, 21 nt, Homo sapiens
ucugaauuguaagaguuguua

SEQ ID NO: 1306 - RNA, 21 nt, Homo sapiens
uaacaacucuuacaauucaga

SEQ ID NO: 1307 - RNA, 23 nt, Homo sapiens
agaacucuugcagucuuagaugu

SEQ ID NO: 1308 - RNA, 23 nt, Homo sapiens
acaucuaagacugcaagaguucu

SEQ ID NO: 1309 - RNA, 22 nt, Homo sapiens
aacgggaaugcaggcuguaucu

SEQ ID NO: 1310 - RNA, 22 nt, Homo sapiens
agauacagccugcauucccguu

SEQ ID NO: 1311 - RNA, 23 nt, Homo sapiens
ucugaguuccuggagccuggucu

SEQ ID NO: 1312 - RNA, 23 nt, Homo sapiens
agaccaggcuccaggaacucaga

SEQ ID NO: 1313 - RNA, 23 nt, Homo sapiens
uggagauccagugcucgcccgau

SEQ ID NO: 1314 - RNA, 23 nt, Homo sapiens
aucgggcgagcacuggaucucca

SEQ ID NO: 1315 - RNA, 22 nt, Homo sapiens
uguugcaagucgguggagacgu

SEQ ID NO: 1316 - RNA, 22 nt, Homo sapiens
acgucuccaccgacuugcaaca

SEQ ID NO: 1317 - RNA, 22 nt, Homo sapiens
cucucuacugacuugcaacaua

SEQ ID NO: 1318 - RNA, 22 nt, Homo sapiens
uauguugcaagucaguagagag

SEQ ID NO: 1319 - RNA, 22 nt, Homo sapiens
ucucccuuccugcccuggcuag

SEQ ID NO: 1320 - RNA, 22 nt, Homo sapiens
cuagccagggcaggaagggaga

SEQ ID NO: 1321 - RNA, 26 nt, Homo sapiens
cccagggcuuggaguggggcaagguu

SEQ ID NO: 1322 - RNA, 26 nt, Homo sapiens
aaccuugccccacuccaagcccuggg

SEQ ID NO: 1323 - RNA, 23 nt, Homo sapiens
uaucugcugggcuuucugguguu

SEQ ID NO: 1324 - RNA, 23 nt, Homo sapiens
aacaccagaaagcccagcagaua

SEQ ID NO: 1325 - RNA, 21 nt, Homo sapiens
uggcuguuggagggggcaggc

SEQ ID NO: 1326 - RNA, 21 nt, Homo sapiens
gccugcccccuccaacagcca

SEQ ID NO: 1327 - RNA, 22 nt, Homo sapiens
cagcccuccucccgcacccaaa

SEQ ID NO: 1328 - RNA, 22 nt, Homo sapiens
uuugggugcgggaggagggcug

SEQ ID NO: 1329 - RNA, 22 nt, Homo sapiens
uaggggcagcagaggaccuggg

SEQ ID NO: 1330 - RNA, 22 nt, Homo sapiens
cccagguccucugcugccccua

SEQ ID NO: 1331 - RNA, 22 nt, Homo sapiens
uugaggagacauggugggggcc

SEQ ID NO: 1332 - RNA, 22 nt, Homo sapiens
ggcccccaccaugucuccucaa

SEQ ID NO: 1333 - RNA, 21 nt, Homo sapiens
gcagcccagcugaggccucug

SEQ ID NO: 1334 - RNA, 21 nt, Homo sapiens
cagaggccucagcugggcugc

SEQ ID NO: 1335 - RNA, 22 nt, Homo sapiens
gagcaggcgaggcugggcugaa

SEQ ID NO: 1336 - RNA, 22 nt, Homo sapiens
uucagcccagccucgccugcuc

SEQ ID NO: 1337 - RNA, 23 nt, Homo sapiens
ccagccacggacugagagugcau

SEQ ID NO: 1338 - RNA, 23 nt, Homo sapiens
augcacucucaguccguggcugg

SEQ ID NO: 1339 - RNA, 23 nt, Homo sapiens
guccuccaggccaugagcugcgg

SEQ ID NO: 1340 - RNA, 23 nt, Homo sapiens
ccgcagcucauggccuggaggac

SEQ ID NO: 1341 - RNA, 22 nt, Homo sapiens
ucaggcaguguggguaucagau

SEQ ID NO: 1342 - RNA, 22 nt, Homo sapiens
aucugauacccacacugccuga

SEQ ID NO: 1343 - RNA, 23 nt, Homo sapiens
ugagaguggaauucacaguauuu

SEQ ID NO: 1344 - RNA, 23 nt, Homo sapiens
aaauacugugaauuccacucuca

SEQ ID NO: 1345 - RNA, 23 nt, Homo sapiens
auacugugaauuucacugucaca

SEQ ID NO: 1346 - RNA, 23 nt, Homo sapiens
ugugacagugaaauucacaguau

SEQ ID NO: 1347 - RNA, 21 nt, Homo sapiens
caaauggacaggauaacaccu

SEQ ID NO: 1348 - RNA, 21 nt, Homo sapiens
agguguuauccuguccauuug

SEQ ID NO: 1349 - RNA, 22 nt, Homo sapiens
agguguuauccuauccauuugc

SEQ ID NO: 1350 - RNA, 22 nt, Homo sapiens
gcaaauggauaggauaacaccu

SEQ ID NO: 1351 - RNA, 22 nt, Homo sapiens
ugaucucaccgcugccuccuuc

SEQ ID NO: 1352 - RNA, 22 nt, Homo sapiens
gaaggaggcagcggugagauca

SEQ ID NO: 1353 - RNA, 22 nt, Homo sapiens
caggaggcagugggcgagcagg

SEQ ID NO: 1354 - RNA, 22 nt, Homo sapiens
ccugcucgcccacugccuccug

SEQ ID NO: 1355 - RNA, 22 nt, Homo sapiens
ugcaagacggauacugucaucu

SEQ ID NO: 1356 - RNA, 22 nt, Homo sapiens
agaugacaguauccgucuugca

SEQ ID NO: 1357 - RNA, 24 nt, Homo sapiens
ugucagugacuccugccccuuggu

SEQ ID NO: 1358 - RNA, 24 nt, Homo sapiens
accaaggggcaggagucacugaca

SEQ ID NO: 1359 - RNA, 22 nt, Homo sapiens
agggggcgcagucacugacgug

SEQ ID NO: 1360 - RNA, 22 nt, Homo sapiens
cacgucagugacugcgcccccu

SEQ ID NO: 1361 - RNA, 23 nt, Homo sapiens
ucaaaauguagaggaagacccca

SEQ ID NO: 1362 - RNA, 23 nt, Homo sapiens
uggggucuuccucuacauuuuga

SEQ ID NO: 1363 - RNA, 22 nt, Homo sapiens
aauuuacucugcaaucuucucc

SEQ ID NO: 1364 - RNA, 22 nt, Homo sapiens
ggagaagauugcagaguaaauu

SEQ ID NO: 1365 - RNA, 22 nt, Homo sapiens
agaagauugcagaguaaguucc

SEQ ID NO: 1366 - RNA, 22 nt, Homo sapiens
ggaacuuacucugcaaucuucu

SEQ ID NO: 1367 - RNA, 26 nt, Homo sapiens
cacaggacugacuccucaccccagug

SEQ ID NO: 1368 - RNA, 26 nt, Homo sapiens
cacuggggugaggagucaguccugug

SEQ ID NO: 1369 - RNA, 22 nt, Homo sapiens
ucuggggaugaggacagugugu

SEQ ID NO: 1370 - RNA, 22 nt, Homo sapiens
acacacuguccucauccccaga

SEQ ID NO: 1371 - RNA, 20 nt, Homo sapiens
augggugauggguguggugu

SEQ ID NO: 1372 - RNA, 20 nt, Homo sapiens
acaccacacccaucacccau

SEQ ID NO: 1373 - RNA, 22 nt, Homo sapiens
uuggccaccacaccuaccccuu

SEQ ID NO: 1374 - RNA, 22 nt, Homo sapiens
aagggguaggugugguggccaa

SEQ ID NO: 1375 - RNA, 22 nt, Homo sapiens
uguaguuguauuguauugccac

SEQ ID NO: 1376 - RNA, 22 nt, Homo sapiens
guggcaauacaauacaacuaca

SEQ ID NO: 1377 - RNA, 23 nt, Homo sapiens
uagcaauacaguacaaauauagu

SEQ ID NO: 1378 - RNA, 23 nt, Homo sapiens
acuauauuuguacuguauugcua

SEQ ID NO: 1379 - RNA, 22 nt, Homo sapiens
ucagucacauaucuagugucua

SEQ ID NO: 1380 - RNA, 22 nt, Homo sapiens
uagacacuagauaugugacuga

SEQ ID NO: 1381 - RNA, 22 nt, Homo sapiens
gacacuaggcaugugagugauu

SEQ ID NO: 1382 - RNA, 22 nt, Homo sapiens
aaucacucacaugccuaguguc

SEQ ID NO: 1383 - RNA, 22 nt, Homo sapiens
ucaaucacuugguaauugcugu

SEQ ID NO: 1384 - RNA, 22 nt, Homo sapiens
acagcaauuaccaagugauuga

SEQ ID NO: 1385 - RNA, 25 nt, Homo sapiens
agcggggaggaagugggcgcugcuu

SEQ ID NO: 1386 - RNA, 25 nt, Homo sapiens
aagcagcgcccacuuccuccccgcu

SEQ ID NO: 1387 - RNA, 22 nt, Homo sapiens
agcccgccccagccgagguucu

SEQ ID NO: 1388 - RNA, 22 nt, Homo sapiens
agaaccucggcuggggcgggcu

SEQ ID NO: 1389 - RNA, 23 nt, Homo sapiens
gccccggcgcgggcggguucugg

SEQ ID NO: 1390 - RNA, 23 nt, Homo sapiens
ccagaacccgcccgcgccggggc

SEQ ID NO: 1391 - RNA, 22 nt, Homo sapiens
agcaaggcggcaucucucugau

SEQ ID NO: 1392 - RNA, 22 nt, Homo sapiens
aucagagagaugccgccuugcu

SEQ ID NO: 1393 - RNA, 21 nt, Homo sapiens
agagaugccgccuugcuccuu

SEQ ID NO: 1394 - RNA, 21 nt, Homo sapiens
aaggagcaaggcggcaucucu

SEQ ID NO: 1395 - RNA, 23 nt, Homo sapiens
uugaagaggaggugcucuguagc

SEQ ID NO: 1396 - RNA, 23 nt, Homo sapiens
gcuacagagcaccuccucuucaa

SEQ ID NO: 1397 - RNA, 22 nt, Homo sapiens
acaacagugacuugcucuccaa

SEQ ID NO: 1398 - RNA, 22 nt, Homo sapiens
uuggagagcaagucacuguugu

SEQ ID NO: 1399 - RNA, 18 nt, Homo sapiens
gggugagggcaggugguu

SEQ ID NO: 1400 - RNA, 18 nt, Homo sapiens
aaccaccugcccucaccc

SEQ ID NO: 1401 - RNA, 18 nt, Homo sapiens
cgugucuucuggcuugau

SEQ ID NO: 1402 - RNA, 18 nt, Homo sapiens
aucaagccagaagacacg

SEQ ID NO: 1403 - RNA, 23 nt, Homo sapiens
ugcaucaggccagaagacaugag

SEQ ID NO: 1404 - RNA, 23 nt, Homo sapiens
cucaugucuucuggccugaugca

SEQ ID NO: 1405 - RNA, 21 nt, Homo sapiens
aaugagagaccuguacuguau

SEQ ID NO: 1406 - RNA, 21 nt, Homo sapiens
auacaguacaggucucucauu

SEQ ID NO: 1407 - RNA, 22 nt, Homo sapiens
uccaguacaggucucucauuuc

SEQ ID NO: 1408 - RNA, 22 nt, Homo sapiens
gaaaugagagaccuguacugga

SEQ ID NO: 1409 - RNA, 22 nt, Homo sapiens
ugggauccagacagugggagaa

SEQ ID NO: 1410 - RNA, 22 nt, Homo sapiens
uucucccacugucuggauccca

SEQ ID NO: 1411 - RNA, 22 nt, Homo sapiens
uucucccacuaccaggcuccca

SEQ ID NO: 1412 - RNA, 22 nt, Homo sapiens
ugggagccugguagugggagaa

SEQ ID NO: 1413 - RNA, 22 nt, Homo sapiens
ccaaccuagguggucagaguug

SEQ ID NO: 1414 - RNA, 22 nt, Homo sapiens
caacucugaccaccuagguugg

SEQ ID NO: 1415 - RNA, 22 nt, Homo sapiens
aacucugaccccuuagguugau

SEQ ID NO: 1416 - RNA, 22 nt, Homo sapiens
aucaaccuaaggggucagaguu

SEQ ID NO: 1417 - RNA, 23 nt, Homo sapiens
gugccaccuuaacugcagccaau

SEQ ID NO: 1418 - RNA, 23 nt, Homo sapiens
auuggcugcaguuaagguggcac

SEQ ID NO: 1419 - RNA, 22 nt, Homo sapiens
aaguuggcugcaguuaaggugg

SEQ ID NO: 1420 - RNA, 22 nt, Homo sapiens
ccaccuuaacugcagccaacuu

SEQ ID NO: 1421 - RNA, 22 nt, Homo sapiens
aagggggaaggaaacauggaga

SEQ ID NO: 1422 - RNA, 22 nt, Homo sapiens
ucuccauguuuccuucccccuu

SEQ ID NO: 1423 - RNA, 22 nt, Homo sapiens
uccauguuuccuucccccuucu

SEQ ID NO: 1424 - RNA, 22 nt, Homo sapiens
agaagggggaaggaaacaugga

SEQ ID NO: 1425 - RNA, 21 nt, Homo sapiens
acacauggguggcuguggccu

SEQ ID NO: 1426 - RNA, 21 nt, Homo sapiens
aggccacagccacccaugugu

SEQ ID NO: 1427 - RNA, 22 nt, Homo sapiens
uaggccacagccacccaugugu

SEQ ID NO: 1428 - RNA, 22 nt, Homo sapiens
acacauggguggcuguggccua

SEQ ID NO: 1429 - RNA, 21 nt, Homo sapiens
agcuguaccugaaaccaagca

SEQ ID NO: 1430 - RNA, 21 nt, Homo sapiens
ugcuugguuucagguacagcu

SEQ ID NO: 1431 - RNA, 22 nt, Homo sapiens
ucacaaaucuauaauaugcagg

SEQ ID NO: 1432 - RNA, 22 nt, Homo sapiens
ccugcauauuauagauuuguga

SEQ ID NO: 1433 - RNA, 21 nt, Homo sapiens
ugcuuaaguuguaccaaguau

SEQ ID NO: 1434 - RNA, 21 nt, Homo sapiens
auacuugguacaacuuaagca

SEQ ID NO: 1435 - RNA, 22 nt, Homo sapiens
ccuggcauauuugguauaacuu

SEQ ID NO: 1436 - RNA, 22 nt, Homo sapiens
aaguuauaccaaauaugccagg

SEQ ID NO: 1437 - RNA, 22 nt, Homo sapiens
ugagggcuccaggugacggugg

SEQ ID NO: 1438 - RNA, 22 nt, Homo sapiens
ccaccgucaccuggagcccuca

SEQ ID NO: 1439 - RNA, 22 nt, Homo sapiens
accugccagcaccucccugcag

SEQ ID NO: 1440 - RNA, 22 nt, Homo sapiens
cugcagggaggugcuggcaggu

SEQ ID NO: 1441 - RNA, 23 nt, Homo sapiens
ggcaggagggcugugccagguug

SEQ ID NO: 1442 - RNA, 23 nt, Homo sapiens
caaccuggcacagcccuccugcc

SEQ ID NO: 1443 - RNA, 22 nt, Homo sapiens
cccucucuggcuccuccccaaa

SEQ ID NO: 1444 - RNA, 22 nt, Homo sapiens
uuuggggaggagccagagaggg

SEQ ID NO: 1445 - RNA, 24 nt, Homo sapiens
ugggggagccaugagauaagagca

SEQ ID NO: 1446 - RNA, 24 nt, Homo sapiens
ugcucuuaucucauggcuccccca

SEQ ID NO: 1447 - RNA, 21 nt, Homo sapiens
guaccuucugguucagcuagu

SEQ ID NO: 1448 - RNA, 21 nt, Homo sapiens
acuagcugaaccagaagguac

SEQ ID NO: 1449 - RNA, 23 nt, Homo sapiens
aacugaaccaggagugagcuucg

SEQ ID NO: 1450 - RNA, 23 nt, Homo sapiens
cgaagcucacuccugguucaguu

SEQ ID NO: 1451 - RNA, 22 nt, Homo sapiens
uggggaaggcgucagugucggg

SEQ ID NO: 1452 - RNA, 22 nt, Homo sapiens
cccgacacugacgccuucccca

SEQ ID NO: 1453 - RNA, 21 nt, Homo sapiens
agacccugcagccuucccacc

SEQ ID NO: 1454 - RNA, 21 nt, Homo sapiens
ggugggaaggcugcagggucu

SEQ ID NO: 1455 - RNA, 22 nt, Homo sapiens
acccagguucccucuggccgca

SEQ ID NO: 1456 - RNA, 22 nt, Homo sapiens
ugcggccagagggaaccugggu

SEQ ID NO: 1457 - RNA, 23 nt, Homo sapiens
agggccagaggagccuggagugg

SEQ ID NO: 1458 - RNA, 23 nt, Homo sapiens
ccacuccaggcuccucuggcccu

SEQ ID NO: 1459 - RNA, 22 nt, Homo sapiens
auagugggaagcuggcagauuc

SEQ ID NO: 1460 - RNA, 22 nt, Homo sapiens
gaaucugccagcuucccacuau

SEQ ID NO: 1461 - RNA, 21 nt, Homo sapiens
aucugccagcuuccacagugg

SEQ ID NO: 1462 - RNA, 21 nt, Homo sapiens
ccacuguggaagcuggcagau

SEQ ID NO: 1463 - RNA, 25 nt, Homo sapiens
caugcugaccucccuccugccccag

SEQ ID NO: 1464 - RNA, 25 nt, Homo sapiens
cuggggcaggagggaggucagcaug

SEQ ID NO: 1465 - RNA, 23 nt, Homo sapiens
ugggaggggagaggcagcaagca

SEQ ID NO: 1466 - RNA, 23 nt, Homo sapiens
ugcuugcugccucuccccuccca

SEQ ID NO: 1467 - RNA, 22 nt, Homo sapiens
ucauuuaucuguugggaagcua

SEQ ID NO: 1468 - RNA, 22 nt, Homo sapiens
uagcuucccaacagauaaauga

SEQ ID NO: 1469 - RNA, 23 nt, Homo sapiens
cuggcggagcccauuccaugcca

SEQ ID NO: 1470 - RNA, 23 nt, Homo sapiens
uggcauggaaugggcuccgccag

SEQ ID NO: 1471 - RNA, 22 nt, Homo sapiens
cacacaaguggcccccaacacu

SEQ ID NO: 1472 - RNA, 22 nt, Homo sapiens
aguguugggggccacuugugug

SEQ ID NO: 1473 - RNA, 22 nt, Homo sapiens
ugcugggggccacaugagugug

SEQ ID NO: 1474 - RNA, 22 nt, Homo sapiens
cacacucauguggcccccagca

SEQ ID NO: 1475 - RNA, 21 nt, Homo sapiens
gcccugaccuguccuguucug

SEQ ID NO: 1476 - RNA, 21 nt, Homo sapiens
cagaacaggacaggucagggc

SEQ ID NO: 1477 - RNA, 23 nt, Homo sapiens
uguagagcagggagcaggaagcu

SEQ ID NO: 1478 - RNA, 23 nt, Homo sapiens
agcuuccugcucccugcucuaca

SEQ ID NO: 1479 - RNA, 22 nt, Homo sapiens
ccaccaggucuagcauugggau

SEQ ID NO: 1480 - RNA, 22 nt, Homo sapiens
aucccaaugcuagaccuggugg

SEQ ID NO: 1481 - RNA, 22 nt, Homo sapiens
aaucccaaugcuagacccggug

SEQ ID NO: 1482 - RNA, 22 nt, Homo sapiens
caccgggucuagcauugggauu

SEQ ID NO: 1483 - RNA, 22 nt, Homo sapiens
gcugcgggcugcggucagggcg

SEQ ID NO: 1484 - RNA, 22 nt, Homo sapiens
cgcccugaccgcagcccgcagc

SEQ ID NO: 1485 - RNA, 21 nt, Homo sapiens
aaaggugcucaaauuagacau

SEQ ID NO: 1486 - RNA, 21 nt, Homo sapiens
augucuaauuugagcaccuuu

SEQ ID NO: 1487 - RNA, 22 nt, Homo sapiens
ccuaauuugaacaccuucggua

SEQ ID NO: 1488 - RNA, 22 nt, Homo sapiens
uaccgaagguguucaaauuagg

SEQ ID NO: 1489 - RNA, 19 nt, Homo sapiens
aggcagguuaucugggcug

SEQ ID NO: 1490 - RNA, 19 nt, Homo sapiens
cagcccagauaaccugccu

SEQ ID NO: 1491 - RNA, 20 nt, Homo sapiens
augcgaggaugcugacagug

SEQ ID NO: 1492 - RNA, 20 nt, Homo sapiens
cacugucagcauccucgcau

SEQ ID NO: 1493 - RNA, 22 nt, Homo sapiens
ugaaacuggagcgccuggagga

SEQ ID NO: 1494 - RNA, 22 nt, Homo sapiens
uccuccaggcgcuccaguuuca

SEQ ID NO: 1495 - RNA, 22 nt, Homo sapiens
accagcgcguuuucaguuucau

SEQ ID NO: 1496 - RNA, 22 nt, Homo sapiens
augaaacugaaaacgcgcuggu

SEQ ID NO: 1497 - RNA, 25 nt, Homo sapiens
aagggaggaggagcggaggggcccu

SEQ ID NO: 1498 - RNA, 25 nt, Homo sapiens
agggccccuccgcuccuccucccuu

SEQ ID NO: 1499 - RNA, 22 nt, Homo sapiens
gcccgagaggauccgucccugc

SEQ ID NO: 1500 - RNA, 22 nt, Homo sapiens
gcagggacggauccucucgggc

SEQ ID NO: 1501 - RNA, 22 nt, Homo sapiens
aggacugauccucucgggcagg

SEQ ID NO: 1502 - RNA, 22 nt, Homo sapiens
ccugcccgagaggaucaguccu

SEQ ID NO: 1503 - RNA, 23 nt, Homo sapiens
ucaggcaaagggauauuuacaga

SEQ ID NO: 1504 - RNA, 23 nt, Homo sapiens
ucuguaaauaucccuuugccuga

SEQ ID NO: 1505 - RNA, 21 nt, Homo sapiens
uuucugucuuuucugguccag

SEQ ID NO: 1506 - RNA, 21 nt, Homo sapiens
cuggaccagaaaagacagaaa

SEQ ID NO: 1507 - RNA, 23 nt, Homo sapiens
uggccggaugggacaggaggcau

SEQ ID NO: 1508 - RNA, 23 nt, Homo sapiens
augccuccugucccauccggcca

SEQ ID NO: 1509 - RNA, 23 nt, Homo sapiens
ucuaaagacuagacuucgcuaug

SEQ ID NO: 1510 - RNA, 23 nt, Homo sapiens
cauagcgaagucuagucuuuaga

SEQ ID NO: 1511 - RNA, 23 nt, Homo sapiens
uggcccggcgacgucucacgguc

SEQ ID NO: 1512 - RNA, 23 nt, Homo sapiens
gaccgugagacgucgccgggcca

SEQ ID NO: 1513 - RNA, 23 nt, Homo sapiens
ugaguggggcucccgggacggcg

SEQ ID NO: 1514 - RNA, 23 nt, Homo sapiens
cgccgucccgggagccccacuca

SEQ ID NO: 1515 - RNA, 21 nt, Homo sapiens
agcggugcuccugcgggccga

SEQ ID NO: 1516 - RNA, 21 nt, Homo sapiens
ucggcccgcaggagcaccgcu

SEQ ID NO: 1517 - RNA, 23 nt, Homo sapiens
ccggucccaggagaaccugcaga

SEQ ID NO: 1518 - RNA, 23 nt, Homo sapiens
ucugcagguucuccugggaccgg

SEQ ID NO: 1519 - RNA, 22 nt, Homo sapiens
aaggcccgggcuuuccucccag

SEQ ID NO: 1520 - RNA, 22 nt, Homo sapiens
cugggaggaaagcccgggccuu

SEQ ID NO: 1521 - RNA, 22 nt, Homo sapiens
agggaaggaggcuuggucuuag

SEQ ID NO: 1522 - RNA, 22 nt, Homo sapiens
cuaagaccaagccuccuucccu

SEQ ID NO: 1523 - RNA, 21 nt, Homo sapiens
gagguuuggggaggauuugcu

SEQ ID NO: 1524 - RNA, 21 nt, Homo sapiens
agcaaauccuccccaaaccuc

SEQ ID NO: 1525 - RNA, 20 nt, Homo sapiens
cgccccuccugcccccacag

SEQ ID NO: 1526 - RNA, 20 nt, Homo sapiens
cugugggggcaggaggggcg

SEQ ID NO: 1527 - RNA, 22 nt, Homo sapiens
ugcggggacaggccagggcauc

SEQ ID NO: 1528 - RNA, 22 nt, Homo sapiens
gaugcccuggccuguccccgca

SEQ ID NO: 1529 - RNA, 22 nt, Homo sapiens
ccugacccacccccucccgcag

SEQ ID NO: 1530 - RNA, 22 nt, Homo sapiens
cugcgggagggggugggucagg

SEQ ID NO: 1531 - RNA, 22 nt, Homo sapiens
cucgggcggaggugguugagug

SEQ ID NO: 1532 - RNA, 22 nt, Homo sapiens
cacucaaccaccuccgcccgag

SEQ ID NO: 1533 - RNA, 24 nt, Homo sapiens
agaggacccguagcugcuagaagg

SEQ ID NO: 1534 - RNA, 24 nt, Homo sapiens
ccuucuagcagcuacggguccucu

SEQ ID NO: 1535 - RNA, 22 nt, Homo sapiens
uuguggaucucaaggaugugcu

SEQ ID NO: 1536 - RNA, 22 nt, Homo sapiens
agcacauccuugagauccacaa

SEQ ID NO: 1537 - RNA, 22 nt, Homo sapiens
uucucuuucuuuagccuugugu

SEQ ID NO: 1538 - RNA, 22 nt, Homo sapiens
acacaaggcuaaagaaagagaa

SEQ ID NO: 1539 - RNA, 22 nt, Homo sapiens
caaggccaaaggaagagaacag

SEQ ID NO: 1540 - RNA, 22 nt, Homo sapiens
cuguucucuuccuuuggccuug

SEQ ID NO: 1541 - RNA, 23 nt, Homo sapiens
augcggaccuggguuagcggagu

SEQ ID NO: 1542 - RNA, 23 nt, Homo sapiens
acuccgcuaacccagguccgcau

SEQ ID NO: 1543 - RNA, 22 nt, Homo sapiens
agccaggcucugaagggaaagu

SEQ ID NO: 1544 - RNA, 22 nt, Homo sapiens
acuuucccuucagagccuggcu

SEQ ID NO: 1545 - RNA, 22 nt, Homo sapiens
uuucccuucagagccuggcuuu

SEQ ID NO: 1546 - RNA, 22 nt, Homo sapiens
aaagccaggcucugaagggaaa

SEQ ID NO: 1547 - RNA, 22 nt, Homo sapiens
ccagagaugguugccuuccuau

SEQ ID NO: 1548 - RNA, 22 nt, Homo sapiens
auaggaaggcaaccaucucugg

SEQ ID NO: 1549 - RNA, 23 nt, Homo sapiens
cagggaggcgcucacucucugcu

SEQ ID NO: 1550 - RNA, 23 nt, Homo sapiens
agcagagagugagcgccucccug

SEQ ID NO: 1551 - RNA, 22 nt, Homo sapiens
caugacgucacagaggcuucgc

SEQ ID NO: 1552 - RNA, 22 nt, Homo sapiens
gcgaagccucugugacgucaug

SEQ ID NO: 1553 - RNA, 23 nt, Homo sapiens
aggccucugugacgucacggugu

SEQ ID NO: 1554 - RNA, 23 nt, Homo sapiens
acaccgugacgucacagaggccu

SEQ ID NO: 1555 - RNA, 23 nt, Homo sapiens
ugccccaccugcugaccacccuc

SEQ ID NO: 1556 - RNA, 23 nt, Homo sapiens
gaggguggucagcagguggggca

SEQ ID NO: 1557 - RNA, 23 nt, Homo sapiens
gugagugggagccgguggggcug

SEQ ID NO: 1558 - RNA, 23 nt, Homo sapiens
cagccccaccggcucccacucac

SEQ ID NO: 1559 - RNA, 21 nt, Homo sapiens
uaggacuagauguuggaauua

SEQ ID NO: 1560 - RNA, 21 nt, Homo sapiens
uaauuccaacaucuaguccua

SEQ ID NO: 1561 - RNA, 22 nt, Homo sapiens
aaauucauguucaaucuaaacc

SEQ ID NO: 1562 - RNA, 22 nt, Homo sapiens
gguuuagauugaacaugaauuu

SEQ ID NO: 1563 - RNA, 22 nt, Homo sapiens
uuuagauugaacaugaaguuag

SEQ ID NO: 1564 - RNA, 22 nt, Homo sapiens
cuaacuucauguucaaucuaaa

SEQ ID NO: 1565 - RNA, 21 nt, Homo sapiens
gagggcaugcgcacuuugucc

SEQ ID NO: 1566 - RNA, 21 nt, Homo sapiens
ggacaaagugcgcaugcccuc

SEQ ID NO: 1567 - RNA, 21 nt, Homo sapiens
acaaggugugcaugccugacc

SEQ ID NO: 1568 - RNA, 21 nt, Homo sapiens
ggucaggcaugcacaccuugu

SEQ ID NO: 1569 - RNA, 22 nt, Homo sapiens
cuucugaucaagauuuguggug

SEQ ID NO: 1570 - RNA, 22 nt, Homo sapiens
caccacaaaucuugaucagaag

SEQ ID NO: 1571 - RNA, 21 nt, Homo sapiens
ccaaaucuugaucagaagccu

SEQ ID NO: 1572 - RNA, 21 nt, Homo sapiens
aggcuucugaucaagauuugg

SEQ ID NO: 1573 - RNA, 24 nt, Homo sapiens
aggcaggggcuggugcugggcggg

SEQ ID NO: 1574 - RNA, 24 nt, Homo sapiens
cccgcccagcaccagccccugccu

SEQ ID NO: 1575 - RNA, 21 nt, Homo sapiens
cgccugcccagcccuccugcu

SEQ ID NO: 1576 - RNA, 21 nt, Homo sapiens
agcaggagggcugggcaggcg

SEQ ID NO: 1577 - RNA, 22 nt, Homo sapiens
uuaacuccuuucacacccaugg

SEQ ID NO: 1578 - RNA, 22 nt, Homo sapiens
ccaugggugugaaaggaguuaa

SEQ ID NO: 1579 - RNA, 21 nt, Homo sapiens
uggauguggaaggaguuaucu

SEQ ID NO: 1580 - RNA, 21 nt, Homo sapiens
agauaacuccuuccacaucca

SEQ ID NO: 1581 - RNA, 22 nt, Homo sapiens
ugagugauugauagcuauguuc

SEQ ID NO: 1582 - RNA, 22 nt, Homo sapiens
gaacauagcuaucaaucacuca

SEQ ID NO: 1583 - RNA, 21 nt, Homo sapiens
auagcaauugcucuuuuggaa

SEQ ID NO: 1584 - RNA, 21 nt, Homo sapiens
uuccaaaagagcaauugcuau

SEQ ID NO: 1585 - RNA, 21 nt, Homo sapiens
ucugaaagagcaguugguguu

SEQ ID NO: 1586 - RNA, 21 nt, Homo sapiens
aacaccaacugcucuuucaga

SEQ ID NO: 1587 - RNA, 23 nt, Homo sapiens
cgcgggcgcuccuggccgccgcc

SEQ ID NO: 1588 - RNA, 23 nt, Homo sapiens
ggcggcggccaggagcgcccgcg

SEQ ID NO: 1589 - RNA, 20 nt, Homo sapiens
ccaggagauccagagagaau

SEQ ID NO: 1590 - RNA, 20 nt, Homo sapiens
auucucucuggaucuccugg

SEQ ID NO: 1591 - RNA, 22 nt, Homo sapiens
auucucucuggaucccauggau

SEQ ID NO: 1592 - RNA, 22 nt, Homo sapiens
auccaugggauccagagagaau

SEQ ID NO: 1593 - RNA, 22 nt, Homo sapiens
ucugccauccucccuccccuac

SEQ ID NO: 1594 - RNA, 22 nt, Homo sapiens
guaggggagggaggauggcaga

SEQ ID NO: 1595 - RNA, 24 nt, Homo sapiens
ggugggauggagagaagguaugag

SEQ ID NO: 1596 - RNA, 24 nt, Homo sapiens
cucauaccuucucuccaucccacc

SEQ ID NO: 1597 - RNA, 18 nt, Homo sapiens
ugagaugacacuguagcu

SEQ ID NO: 1598 - RNA, 18 nt, Homo sapiens
agcuacagugucaucuca

SEQ ID NO: 1599 - RNA, 21 nt, Homo sapiens
agcagacuugaccuacaauua

SEQ ID NO: 1600 - RNA, 21 nt, Homo sapiens
uaauuguaggucaagucugcu

SEQ ID NO: 1601 - RNA, 22 nt, Homo sapiens
cagaacaggagcauagaaaggc

SEQ ID NO: 1602 - RNA, 22 nt, Homo sapiens
gccuuucuaugcuccuguucug

SEQ ID NO: 1603 - RNA, 22 nt, Homo sapiens
uuaauuuuuuguuucggucacu

SEQ ID NO: 1604 - RNA, 22 nt, Homo sapiens
agugaccgaaacaaaaaauuaa

SEQ ID NO: 1605 - RNA, 23 nt, Homo sapiens
cuugccauccugguccacugcau

SEQ ID NO: 1606 - RNA, 23 nt, Homo sapiens
augcaguggaccaggauggcaag

SEQ ID NO: 1607 - RNA, 22 nt, Homo sapiens
guggaccaggauggcaagggcu

SEQ ID NO: 1608 - RNA, 22 nt, Homo sapiens
agcccuugccauccugguccac

SEQ ID NO: 1609 - RNA, 22 nt, Homo sapiens
auaccucaucuagaaugcugua

SEQ ID NO: 1610 - RNA, 22 nt, Homo sapiens
uacagcauucuagaugagguau

SEQ ID NO: 1611 - RNA, 22 nt, Homo sapiens
uucuagaugagagauauauaua

SEQ ID NO: 1612 - RNA, 22 nt, Homo sapiens
uauauauaucucucaucuagaa

SEQ ID NO: 1613 - RNA, 22 nt, Homo sapiens
ucuucuuccuuugcagaguuga

SEQ ID NO: 1614 - RNA, 22 nt, Homo sapiens
ucaacucugcaaaggaagaaga

SEQ ID NO: 1615 - RNA, 22 nt, Homo sapiens
aauucuguaaaggaagaagagg

SEQ ID NO: 1616 - RNA, 22 nt, Homo sapiens
ccucuucuuccuuuacagaauu

SEQ ID NO: 1617 - RNA, 22 nt, Homo sapiens
uaggagggaauaguaaaagcag

SEQ ID NO: 1618 - RNA, 22 nt, Homo sapiens
cugcuuuuacuauucccuccua

SEQ ID NO: 1619 - RNA, 22 nt, Homo sapiens
acccuugagccugaucccuagc

SEQ ID NO: 1620 - RNA, 22 nt, Homo sapiens
gcuagggaucaggcucaagggu

SEQ ID NO: 1621 - RNA, 22 nt, Homo sapiens
aauguuggaauccucgcuagag

SEQ ID NO: 1622 - RNA, 22 nt, Homo sapiens
cucuagcgaggauuccaacauu

SEQ ID NO: 1623 - RNA, 21 nt, Homo sapiens
uagcggggauuccaauauugg

SEQ ID NO: 1624 - RNA, 21 nt, Homo sapiens
ccaauauuggaauccccgcua

SEQ ID NO: 1625 - RNA, 22 nt, Homo sapiens
ugauugucuucauaucuagaac

SEQ ID NO: 1626 - RNA, 22 nt, Homo sapiens
guucuagauaugaagacaauca

SEQ ID NO: 1627 - RNA, 22 nt, Homo sapiens
uucuggauaugaagacaaucaa

SEQ ID NO: 1628 - RNA, 22 nt, Homo sapiens
uugauugucuucauauccagaa

SEQ ID NO: 1629 - RNA, 23 nt, Homo sapiens
ccccgguguuggggcgcgucugc

SEQ ID NO: 1630 - RNA, 23 nt, Homo sapiens
gcagacgcgccccaacaccgggg

SEQ ID NO: 1631 - RNA, 21 nt, Homo sapiens
ggcgcgcccagcucccgggcu

SEQ ID NO: 1632 - RNA, 21 nt, Homo sapiens
agcccgggagcugggcgcgcc

SEQ ID NO: 1633 - RNA, 20 nt, Homo sapiens
ugaggagaugcugggacuga

SEQ ID NO: 1634 - RNA, 20 nt, Homo sapiens
ucagucccagcaucuccuca

SEQ ID NO: 1635 - RNA, 21 nt, Homo sapiens
agagucggcgacgccgccagc

SEQ ID NO: 1636 - RNA, 21 nt, Homo sapiens
gcuggcggcgucgccgacucu

SEQ ID NO: 1637 - RNA, 22 nt, Homo sapiens
ugaagccagcucuggucugggc

SEQ ID NO: 1638 - RNA, 22 nt, Homo sapiens
gcccagaccagagcuggcuuca

SEQ ID NO: 1639 - RNA, 22 nt, Homo sapiens
ugagaccaggacuggaugcacc

SEQ ID NO: 1640 - RNA, 22 nt, Homo sapiens
ggugcauccaguccuggucuca

SEQ ID NO: 1641 - RNA, 24 nt, Homo sapiens
gaugcgccgcccacugccccgcgc

SEQ ID NO: 1642 - RNA, 24 nt, Homo sapiens
gcgcggggcagugggcggcgcauc

SEQ ID NO: 1643 - RNA, 22 nt, Homo sapiens
gcggggguggcggcggcauccc

SEQ ID NO: 1644 - RNA, 22 nt, Homo sapiens
gggaugccgccgccacccccgc

SEQ ID NO: 1645 - RNA, 22 nt, Homo sapiens
uuacggaccagcuaagggaggc

SEQ ID NO: 1646 - RNA, 22 nt, Homo sapiens
gccucccuuagcugguccguaa

SEQ ID NO: 1647 - RNA, 21 nt, Homo sapiens
cacacauagcagguguauaua

SEQ ID NO: 1648 - RNA, 21 nt, Homo sapiens
uauauacaccugcuaugugug

SEQ ID NO: 1649 - RNA, 22 nt, Homo sapiens
guauacaccugauauguguaug

SEQ ID NO: 1650 - RNA, 22 nt, Homo sapiens
cauacacauaucagguguauac

SEQ ID NO: 1651 - RNA, 22 nt, Homo sapiens
ugaaugguaaagcgaugucaca

SEQ ID NO: 1652 - RNA, 22 nt, Homo sapiens
ugugacaucgcuuuaccauuca

SEQ ID NO: 1653 - RNA, 20 nt, Homo sapiens
aucgcuuuaccauucauguu

SEQ ID NO: 1654 - RNA, 20 nt, Homo sapiens
aacaugaaugguaaagcgau

SEQ ID NO: 1655 - RNA, 18 nt, Homo sapiens
uggauaugaugacugaaa

SEQ ID NO: 1656 - RNA, 18 nt, Homo sapiens
uuucagucaucauaucca

SEQ ID NO: 1657 - RNA, 18 nt, Homo sapiens
cggugagcgcucgcuggc

SEQ ID NO: 1658 - RNA, 18 nt, Homo sapiens
gccagcgagcgcucaccg

SEQ ID NO: 1659 - RNA, 23 nt, Homo sapiens
ucugcacugugaguuggcuggcu

SEQ ID NO: 1660 - RNA, 23 nt, Homo sapiens
agccagccaacucacagugcaga

SEQ ID NO: 1661 - RNA, 24 nt, Homo sapiens
acauccugcuccacagggcagagg

SEQ ID NO: 1662 - RNA, 24 nt, Homo sapiens
ccucugcccuguggagcaggaugu

SEQ ID NO: 1663 - RNA, 22 nt, Homo sapiens
ucuggcuaucucacgagacugu

SEQ ID NO: 1664 - RNA, 22 nt, Homo sapiens
acagucucgugagauagccaga

SEQ ID NO: 1665 - RNA, 22 nt, Homo sapiens
auauuauuagccacuucuggau

SEQ ID NO: 1666 - RNA, 22 nt, Homo sapiens
auccagaaguggcuaauaauau

SEQ ID NO: 1667 - RNA, 21 nt, Homo sapiens
agaaguggcuaauaauauuga

SEQ ID NO: 1668 - RNA, 21 nt, Homo sapiens
ucaauauuauuagccacuucu

SEQ ID NO: 1669 - RNA, 22 nt, Homo sapiens
uaaaguggcagaguauagacac

SEQ ID NO: 1670 - RNA, 22 nt, Homo sapiens
gugucuauacucugccacuuua

SEQ ID NO: 1671 - RNA, 22 nt, Homo sapiens
ugucuauacucugucacuuuac

SEQ ID NO: 1672 - RNA, 22 nt, Homo sapiens
guaaagugacagaguauagaca

SEQ ID NO: 1673 - RNA, 21 nt, Homo sapiens
ucucaguaaguggcacucugu

SEQ ID NO: 1674 - RNA, 21 nt, Homo sapiens
acagagugccacuuacugaga

SEQ ID NO: 1675 - RNA, 21 nt, Homo sapiens
gacagagugccacuuacugaa

SEQ ID NO: 1676 - RNA, 21 nt, Homo sapiens
uucaguaaguggcacucuguc

SEQ ID NO: 1677 - RNA, 22 nt, Homo sapiens
aacucacgaaguauaccgaagu

SEQ ID NO: 1678 - RNA, 22 nt, Homo sapiens
acuucgguauacuucgugaguu

SEQ ID NO: 1679 - RNA, 22 nt, Homo sapiens
uucgguauacuuugugaauugg

SEQ ID NO: 1680 - RNA, 22 nt, Homo sapiens
ccaauucacaaaguauaccgaa

SEQ ID NO: 1681 - RNA, 22 nt, Homo sapiens
acuggcaugcugcauuuauaua

SEQ ID NO: 1682 - RNA, 22 nt, Homo sapiens
uauauaaaugcagcaugccagu

SEQ ID NO: 1683 - RNA, 22 nt, Homo sapiens
aucuaaaugcagcaugccaguc

SEQ ID NO: 1684 - RNA, 22 nt, Homo sapiens
gacuggcaugcugcauuuagau

SEQ ID NO: 1685 - RNA, 19 nt, Homo sapiens
cauccguccgucuguccac

SEQ ID NO: 1686 - RNA, 19 nt, Homo sapiens
guggacagacggacggaug

SEQ ID NO: 1687 - RNA, 21 nt, Homo sapiens
aguggaccgaggaaggaagga

SEQ ID NO: 1688 - RNA, 21 nt, Homo sapiens
uccuuccuuccucgguccacu

SEQ ID NO: 1689 - RNA, 22 nt, Homo sapiens
uacacaagaaaaccaaggcuca

SEQ ID NO: 1690 - RNA, 22 nt, Homo sapiens
ugagccuugguuuucuugugua

SEQ ID NO: 1691 - RNA, 21 nt, Homo sapiens
uaacauaauaguguggauuga

SEQ ID NO: 1692 - RNA, 21 nt, Homo sapiens
ucaauccacacuauuauguua

SEQ ID NO: 1693 - RNA, 21 nt, Homo sapiens
ugcuuaaccuugcccucgaaa

SEQ ID NO: 1694 - RNA, 21 nt, Homo sapiens
uuucgagggcaagguuaagca

SEQ ID NO: 1695 - RNA, 21 nt, Homo sapiens
uuggacgguaagguuaagcaa

SEQ ID NO: 1696 - RNA, 21 nt, Homo sapiens
uugcuuaaccuuaccguccaa

SEQ ID NO: 1697 - RNA, 21 nt, Homo sapiens
aaaagcaucaggaaguaccca

SEQ ID NO: 1698 - RNA, 21 nt, Homo sapiens
uggguacuuccugaugcuuuu

SEQ ID NO: 1699 - RNA, 21 nt, Homo sapiens
gcaggacaggcagaaguggau

SEQ ID NO: 1700 - RNA, 21 nt, Homo sapiens
auccacuucugccuguccugc

SEQ ID NO: 1701 - RNA, 22 nt, Homo sapiens
cagggcuggcagugacaugggu

SEQ ID NO: 1702 - RNA, 22 nt, Homo sapiens
acccaugucacugccagcccug

SEQ ID NO: 1703 - RNA, 22 nt, Homo sapiens
auuucccugccauucccuuggc

SEQ ID NO: 1704 - RNA, 22 nt, Homo sapiens
gccaagggaauggcagggaaau

SEQ ID NO: 1705 - RNA, 22 nt, Homo sapiens
uggcggcgguaguuaugggcuu

SEQ ID NO: 1706 - RNA, 22 nt, Homo sapiens
aagcccauaacuaccgccgcca

SEQ ID NO: 1707 - RNA, 22 nt, Homo sapiens
gcucccucuagggucgcucgga

SEQ ID NO: 1708 - RNA, 22 nt, Homo sapiens
uccgagcgacccuagagggagc

SEQ ID NO: 1709 - RNA, 22 nt, Homo sapiens
ugggaacuuaguagagguuuaa

SEQ ID NO: 1710 - RNA, 22 nt, Homo sapiens
uuaaaccucuacuaaguuccca

SEQ ID NO: 1711 - RNA, 21 nt, Homo sapiens
uggggcuagugaugcaggacg

SEQ ID NO: 1712 - RNA, 21 nt, Homo sapiens
cguccugcaucacuagcccca

SEQ ID NO: 1713 - RNA, 22 nt, Homo sapiens
gcugacagcagggcuggccgcu

SEQ ID NO: 1714 - RNA, 22 nt, Homo sapiens
agcggccagcccugcugucagc

SEQ ID NO: 1715 - RNA, 21 nt, Homo sapiens
auuggacugcugauggcccgu

SEQ ID NO: 1716 - RNA, 21 nt, Homo sapiens
acgggccaucagcaguccaau

SEQ ID NO: 1717 - RNA, 22 nt, Homo sapiens
aggccaucagcaguccaaugaa

SEQ ID NO: 1718 - RNA, 22 nt, Homo sapiens
uucauuggacugcugauggccu

SEQ ID NO: 1719 - RNA, 22 nt, Homo sapiens
uuggacagaaaacacgcaggaa

SEQ ID NO: 1720 - RNA, 22 nt, Homo sapiens
uuccugcguguuuucuguccaa

SEQ ID NO: 1721 - RNA, 20 nt, Homo sapiens
ccugcguguuuucuguccaa

SEQ ID NO: 1722 - RNA, 20 nt, Homo sapiens
uuggacagaaaacacgcagg

SEQ ID NO: 1723 - RNA, 22 nt, Homo sapiens
ugagacaggcuuaugcugcuau

SEQ ID NO: 1724 - RNA, 22 nt, Homo sapiens
auagcagcauaagccugucuca

SEQ ID NO: 1725 - RNA, 22 nt, Homo sapiens
auagcagcaugaaccugucuca

SEQ ID NO: 1726 - RNA, 22 nt, Homo sapiens
ugagacagguucaugcugcuau

SEQ ID NO: 1727 - RNA, 20 nt, Homo sapiens
gagacagguucaugcugcua

SEQ ID NO: 1728 - RNA, 20 nt, Homo sapiens
uagcagcaugaaccugucuc

SEQ ID NO: 1729 - RNA, 21 nt, Homo sapiens
auagcagcauaagccugucuc

SEQ ID NO: 1730 - RNA, 21 nt, Homo sapiens
gagacaggcuuaugcugcuau

SEQ ID NO: 1731 - RNA, 22 nt, Homo sapiens
uguguggauccuggaggaggca

SEQ ID NO: 1732 - RNA, 22 nt, Homo sapiens
ugccuccuccaggauccacaca

SEQ ID NO: 1733 - RNA, 22 nt, Homo sapiens
agacaucaagaucagucccaaa

SEQ ID NO: 1734 - RNA, 22 nt, Homo sapiens
uuugggacugaucuugaugucu

SEQ ID NO: 1735 - RNA, 22 nt, Homo sapiens
uuugggacugaucuugaugucu

SEQ ID NO: 1736 - RNA, 22 nt, Homo sapiens
agacaucaagaucagucccaaa

SEQ ID NO: 1737 - RNA, 22 nt, Homo sapiens
aaggaaccagaaaaugagaagu

SEQ ID NO: 1738 - RNA, 22 nt, Homo sapiens
acuucucauuuucugguuccuu

SEQ ID NO: 1739 - RNA, 22 nt, Homo sapiens
ucuggccuugacuugacucuuu

SEQ ID NO: 1740 - RNA, 22 nt, Homo sapiens
aaagagucaagucaaggccaga

SEQ ID NO: 1741 - RNA, 23 nt, Homo sapiens
ucaaggccagaggucccacagca

SEQ ID NO: 1742 - RNA, 23 nt, Homo sapiens
ugcugugggaccucuggccuuga

SEQ ID NO: 1743 - RNA, 21 nt, Homo sapiens
acuccaguuuuaguucucuug

SEQ ID NO: 1744 - RNA, 21 nt, Homo sapiens
caagagaacuaaaacuggagu

SEQ ID NO: 1745 - RNA, 22 nt, Homo sapiens
aagagaacugaaaguggagccu

SEQ ID NO: 1746 - RNA, 22 nt, Homo sapiens
aggcuccacuuucaguucucuu

SEQ ID NO: 1747 - RNA, 22 nt, Homo sapiens
uaagggguguauggcagaugca

SEQ ID NO: 1748 - RNA, 22 nt, Homo sapiens
ugcaucugccauacaccccuua

SEQ ID NO: 1749 - RNA, 21 nt, Homo sapiens
uuucagauaacaguauuacau

SEQ ID NO: 1750 - RNA, 21 nt, Homo sapiens
auguaauacuguuaucugaaa

SEQ ID NO: 1751 - RNA, 22 nt, Homo sapiens
aagcaauacuguuaccugaaau

SEQ ID NO: 1752 - RNA, 22 nt, Homo sapiens
auuucagguaacaguauugcuu

SEQ ID NO: 1753 - RNA, 22 nt, Homo sapiens
uacuaacugcagauucaaguga

SEQ ID NO: 1754 - RNA, 22 nt, Homo sapiens
ucacuugaaucugcaguuagua

SEQ ID NO: 1755 - RNA, 21 nt, Homo sapiens
auugccuaacaugugccagaa

SEQ ID NO: 1756 - RNA, 21 nt, Homo sapiens
uucuggcacauguuaggcaau

SEQ ID NO: 1757 - RNA, 22 nt, Homo sapiens
ucugguauguaguagguaauaa

SEQ ID NO: 1758 - RNA, 22 nt, Homo sapiens
uuauuaccuacuacauaccaga

SEQ ID NO: 1759 - RNA, 22 nt, Homo sapiens
aguugccuuuuuguucccaugc

SEQ ID NO: 1760 - RNA, 22 nt, Homo sapiens
gcaugggaacaaaaaggcaacu

SEQ ID NO: 1761 - RNA, 21 nt, Homo sapiens
auaggcaccaaaaagcaacaa

SEQ ID NO: 1762 - RNA, 21 nt, Homo sapiens
uuguugcuuuuuggugccuau

SEQ ID NO: 1763 - RNA, 22 nt, Homo sapiens
ccugcaacuuugccugaucaga

SEQ ID NO: 1764 - RNA, 22 nt, Homo sapiens
ucugaucaggcaaaguugcagg

SEQ ID NO: 1765 - RNA, 22 nt, Homo sapiens
ugaucaggcaaaauugcagacu

SEQ ID NO: 1766 - RNA, 22 nt, Homo sapiens
agucugcaauuuugccugauca

SEQ ID NO: 1767 - RNA, 22 nt, Homo sapiens
uuguggcuggucaugaggcuaa

SEQ ID NO: 1768 - RNA, 22 nt, Homo sapiens
uuagccucaugaccagccacaa

SEQ ID NO: 1769 - RNA, 21 nt, Homo sapiens
uuagucucaugaucagacaca

SEQ ID NO: 1770 - RNA, 21 nt, Homo sapiens
ugugucugaucaugagacuaa

SEQ ID NO: 1771 - RNA, 22 nt, Homo sapiens
aaagauagacaauuggcuaaau

SEQ ID NO: 1772 - RNA, 22 nt, Homo sapiens
auuuagccaauugucuaucuuu

SEQ ID NO: 1773 - RNA, 22 nt, Homo sapiens
uuagccaauuguccaucuuuag

SEQ ID NO: 1774 - RNA, 22 nt, Homo sapiens
cuaaagauggacaauuggcuaa

SEQ ID NO: 1775 - RNA, 22 nt, Homo sapiens
ucugugagaccaaagaacuacu

SEQ ID NO: 1776 - RNA, 22 nt, Homo sapiens
aguaguucuuuggucucacaga

SEQ ID NO: 1777 - RNA, 22 nt, Homo sapiens
uuguucuuuggucuuucagcca

SEQ ID NO: 1778 - RNA, 22 nt, Homo sapiens
uggcugaaagaccaaagaacaa

SEQ ID NO: 1779 - RNA, 23 nt, Homo sapiens
cgggcuguccggaggggucggcu

SEQ ID NO: 1780 - RNA, 23 nt, Homo sapiens
agccgaccccuccggacagcccg

SEQ ID NO: 1781 - RNA, 23 nt, Homo sapiens
ucuguauucuccuuugccugcag

SEQ ID NO: 1782 - RNA, 23 nt, Homo sapiens
cugcaggcaaaggagaauacaga

SEQ ID NO: 1783 - RNA, 23 nt, Homo sapiens
uacauggauggaaaccuucaagc

SEQ ID NO: 1784 - RNA, 23 nt, Homo sapiens
gcuugaagguuuccauccaugua

SEQ ID NO: 1785 - RNA, 22 nt, Homo sapiens
uauggagguucuagaccauguu

SEQ ID NO: 1786 - RNA, 22 nt, Homo sapiens
aacauggucuagaaccuccaua

SEQ ID NO: 1787 - RNA, 22 nt, Homo sapiens
gggaccauccugccugcugugg

SEQ ID NO: 1788 - RNA, 22 nt, Homo sapiens
ccacagcaggcaggaugguccc

SEQ ID NO: 1789 - RNA, 22 nt, Homo sapiens
ucagcaggcaggcuggugcagc

SEQ ID NO: 1790 - RNA, 22 nt, Homo sapiens
gcugcaccagccugccugcuga

SEQ ID NO: 1791 - RNA, 22 nt, Homo sapiens
ucaccugaccucccaugccugu

SEQ ID NO: 1792 - RNA, 22 nt, Homo sapiens
acaggcaugggaggucagguga

SEQ ID NO: 1793 - RNA, 22 nt, Homo sapiens
caggcacgggagcucaggugag

SEQ ID NO: 1794 - RNA, 22 nt, Homo sapiens
cucaccugagcucccgugccug

SEQ ID NO: 1795 - RNA, 21 nt, Homo sapiens
ugaguguugucuacgagggca

SEQ ID NO: 1796 - RNA, 21 nt, Homo sapiens
ugcccucguagacaacacuca

SEQ ID NO: 1797 - RNA, 21 nt, Homo sapiens
acugacaggagagcauuuuga

SEQ ID NO: 1798 - RNA, 21 nt, Homo sapiens
ucaaaaugcucuccugucagu

SEQ ID NO: 1799 - RNA, 22 nt, Homo sapiens
ugaccugggacucggacagcug

SEQ ID NO: 1800 - RNA, 22 nt, Homo sapiens
cagcuguccgagucccagguca

SEQ ID NO: 1801 - RNA, 22 nt, Homo sapiens
ucucaggaguaaagacagaguu

SEQ ID NO: 1802 - RNA, 22 nt, Homo sapiens
aacucugucuuuacuccugaga

SEQ ID NO: 1803 - RNA, 22 nt, Homo sapiens
aacucugucuucacucaugagu

SEQ ID NO: 1804 - RNA, 22 nt, Homo sapiens
acucaugagugaagacagaguu

SEQ ID NO: 1805 - RNA, 22 nt, Homo sapiens
uggggcggagcuuccggaggcc

SEQ ID NO: 1806 - RNA, 22 nt, Homo sapiens
ggccuccggaagcuccgcccca

SEQ ID NO: 1807 - RNA, 22 nt, Homo sapiens
caaucagcaaguauacugcccu

SEQ ID NO: 1808 - RNA, 22 nt, Homo sapiens
agggcaguauacuugcugauug

SEQ ID NO: 1809 - RNA, 22 nt, Homo sapiens
uggcagugucuuagcugguugu

SEQ ID NO: 1810 - RNA, 22 nt, Homo sapiens
acaaccagcuaagacacugcca

SEQ ID NO: 1811 - RNA, 22 nt, Homo sapiens
ccaauauuggcugugcugcucc

SEQ ID NO: 1812 - RNA, 22 nt, Homo sapiens
ggagcagcacagccaauauugg

SEQ ID NO: 1813 - RNA, 21 nt, Homo sapiens
uagcagcacagaaauauuggc

SEQ ID NO: 1814 - RNA, 21 nt, Homo sapiens
gccaauauuucugugcugcua

SEQ ID NO: 1815 - RNA, 21 nt, Homo sapiens
uaauuuuauguauaagcuagu

SEQ ID NO: 1816 - RNA, 21 nt, Homo sapiens
acuagcuuauacauaaaauua

SEQ ID NO: 1817 - RNA, 22 nt, Homo sapiens
gagcuuauucauaaaagugcag

SEQ ID NO: 1818 - RNA, 22 nt, Homo sapiens
cugcacuuuuaugaauaagcuc

SEQ ID NO: 1819 - RNA, 22 nt, Homo sapiens
aagacgggaggaaagaagggag

SEQ ID NO: 1820 - RNA, 22 nt, Homo sapiens
cucccuucuuuccucccgucuu

SEQ ID NO: 1821 - RNA, 22 nt, Homo sapiens
cagugguuuuacccuaugguag

SEQ ID NO: 1822 - RNA, 22 nt, Homo sapiens
cuaccauaggguaaaaccacug

SEQ ID NO: 1823 - RNA, 22 nt, Homo sapiens
auucuaauuucuccacgucuuu

SEQ ID NO: 1824 - RNA, 22 nt, Homo sapiens
aaagacguggagaaauuagaau

SEQ ID NO: 1825 - RNA, 22 nt, Homo sapiens
aaccagcaccccaacuuuggac

SEQ ID NO: 1826 - RNA, 22 nt, Homo sapiens
guccaaaguuggggugcugguu

SEQ ID NO: 1827 - RNA, 24 nt, Homo sapiens
aaagacauaggauagagucaccuc

SEQ ID NO: 1828 - RNA, 24 nt, Homo sapiens
gaggugacucuauccuaugucuuu

SEQ ID NO: 1829 - RNA, 22 nt, Homo sapiens
uaacugguugaacaacugaacc

SEQ ID NO: 1830 - RNA, 22 nt, Homo sapiens
gguucaguuguucaaccaguua

SEQ ID NO: 1831 - RNA, 20 nt, Homo sapiens
cgugccacccuuuuccccag

SEQ ID NO: 1832 - RNA, 20 nt, Homo sapiens
cuggggaaaaggguggcacg

SEQ ID NO: 1833 - RNA, 17 nt, Homo sapiens
guggggccaggcggugg

SEQ ID NO: 1834 - RNA, 17 nt, Homo sapiens
ccaccgccuggccccac

SEQ ID NO: 1835 - RNA, 22 nt, Homo sapiens
aaaagcuggguugagagggcaa

SEQ ID NO: 1836 - RNA, 22 nt, Homo sapiens
uugcccucucaacccagcuuuu

SEQ ID NO: 1837 - RNA, 22 nt, Homo sapiens
gguccagaggggagauagguuc

SEQ ID NO: 1838 - RNA, 22 nt, Homo sapiens
gaaccuaucuccccucuggacc

SEQ ID NO: 1839 - RNA, 23 nt, Homo sapiens
uagccuucagaucuugguguuuu

SEQ ID NO: 1840 - RNA, 23 nt, Homo sapiens
aaaacaccaagaucugaaggcua

SEQ ID NO: 1841 - RNA, 23 nt, Homo sapiens
ccacuuggaucugaaggcugccc

SEQ ID NO: 1842 - RNA, 23 nt, Homo sapiens
gggcagccuucagauccaagugg

SEQ ID NO: 1843 - RNA, 22 nt, Homo sapiens
ugugcgcagggagaccucuccc

SEQ ID NO: 1844 - RNA, 22 nt, Homo sapiens
gggagaggucucccugcgcaca

SEQ ID NO: 1845 - RNA, 22 nt, Homo sapiens
ugucuacuacuggagacacugg

SEQ ID NO: 1846 - RNA, 22 nt, Homo sapiens
ccagugucuccaguaguagaca

SEQ ID NO: 1847 - RNA, 21 nt, Homo sapiens
aaggcagggcccccgcucccc

SEQ ID NO: 1848 - RNA, 21 nt, Homo sapiens
ggggagcgggggcccugccuu

SEQ ID NO: 1849 - RNA, 21 nt, Homo sapiens
cugacuguugccguccuccag

SEQ ID NO: 1850 - RNA, 21 nt, Homo sapiens
cuggaggacggcaacagucag

SEQ ID NO: 1851 - RNA, 25 nt, Homo sapiens
aaaaaccacaauuacuuuugcacca

SEQ ID NO: 1852 - RNA, 25 nt, Homo sapiens
uggugcaaaaguaauugugguuuuu

SEQ ID NO: 1853 - RNA, 23 nt, Homo sapiens
caaaaaccgcaauuacuuuugca

SEQ ID NO: 1854 - RNA, 23 nt, Homo sapiens
ugcaaaaguaauugcgguuuuug

SEQ ID NO: 1855 - RNA, 22 nt, Homo sapiens
augugccugagggaguaagaca

SEQ ID NO: 1856 - RNA, 22 nt, Homo sapiens
ugucuuacucccucaggcacau

SEQ ID NO: 1857 - RNA, 20 nt, Homo sapiens
ucuuacucccucaggcacug

SEQ ID NO: 1858 - RNA, 20 nt, Homo sapiens
cagugccugagggaguaaga

SEQ ID NO: 1859 - RNA, 22 nt, Homo sapiens
agacacauuuggagagggaccc

SEQ ID NO: 1860 - RNA, 22 nt, Homo sapiens
gggucccucuccaaaugugucu

SEQ ID NO: 1861 - RNA, 22 nt, Homo sapiens
gguucccucuccaaaugugucu

SEQ ID NO: 1862 - RNA, 22 nt, Homo sapiens
agacacauuuggagagggaacc

SEQ ID NO: 1863 - RNA, 21 nt, Homo sapiens
aaaauuucuuucacuacuuag

SEQ ID NO: 1864 - RNA, 21 nt, Homo sapiens
cuaaguagugaaagaaauuuu

SEQ ID NO: 1865 - RNA, 21 nt, Homo sapiens
uuagugaaggcuauuuuaauu

SEQ ID NO: 1866 - RNA, 21 nt, Homo sapiens
aauuaaaauagccuucacuaa

SEQ ID NO: 1867 - RNA, 20 nt, Homo sapiens
acuguaaacgcuuucugaug

SEQ ID NO: 1868 - RNA, 20 nt, Homo sapiens
caucagaaagcguuuacagu

SEQ ID NO: 1869 - RNA, 22 nt, Homo sapiens
gcaugugaugaagcaaaucagu

SEQ ID NO: 1870 - RNA, 22 nt, Homo sapiens
acugauuugcuucaucacaugc

SEQ ID NO: 1871 - RNA, 24 nt, Homo sapiens
caaagugaugaguaauacuggcug

SEQ ID NO: 1872 - RNA, 24 nt, Homo sapiens
cagccaguauuacucaucacuuug

SEQ ID NO: 1873 - RNA, 20 nt, Homo sapiens
gaaucggaaaggaggcgccg

SEQ ID NO: 1874 - RNA, 20 nt, Homo sapiens
cggcgccuccuuuccgauuc

SEQ ID NO: 1875 - RNA, 21 nt, Homo sapiens
uugugaagaaagaaauucuua

SEQ ID NO: 1876 - RNA, 21 nt, Homo sapiens
uaagaauuucuuucuucacaa

SEQ ID NO: 1877 - RNA, 22 nt, Homo sapiens
aggaggcaucuugagaaaugga

SEQ ID NO: 1878 - RNA, 22 nt, Homo sapiens
uccauuucucaagaugccuccu

SEQ ID NO: 1879 - RNA, 24 nt, Homo sapiens
acaaaaaaaaaagcccaacccuuc

SEQ ID NO: 1880 - RNA, 24 nt, Homo sapiens
gaaggguugggcuuuuuuuuuugu

SEQ ID NO: 1881 - RNA, 22 nt, Homo sapiens
uguuguacuuuuuuuuuuguuc

SEQ ID NO: 1882 - RNA, 22 nt, Homo sapiens
gaacaaaaaaaaaaguacaaca

SEQ ID NO: 1883 - RNA, 21 nt, Homo sapiens
ucucucggcuccucgcggcuc

SEQ ID NO: 1884 - RNA, 21 nt, Homo sapiens
gagccgcgaggagccgagaga

SEQ ID NO: 1885 - RNA, 23 nt, Homo sapiens
cgagggcauuucaugaugcaggc

SEQ ID NO: 1886 - RNA, 23 nt, Homo sapiens
gccugcaucaugaaaugcccucg

SEQ ID NO: 1887 - RNA, 22 nt, Homo sapiens
augaagugcacucaugauaugu

SEQ ID NO: 1888 - RNA, 22 nt, Homo sapiens
acauaucaugagugcacuucau

SEQ ID NO: 1889 - RNA, 22 nt, Homo sapiens
ugucuacauuaaugaaaagagc

SEQ ID NO: 1890 - RNA, 22 nt, Homo sapiens
gcucuuuucauuaauguagaca

SEQ ID NO: 1891 - RNA, 22 nt, Homo sapiens
ucacccugcaucccgcacccag

SEQ ID NO: 1892 - RNA, 22 nt, Homo sapiens
cugggugcgggaugcaggguga

SEQ ID NO: 1893 - RNA, 22 nt, Homo sapiens
gugggcugggcugggcugggcc

SEQ ID NO: 1894 - RNA, 22 nt, Homo sapiens
ggcccagcccagcccagcccac

SEQ ID NO: 1895 - RNA, 20 nt, Homo sapiens
cgcgggucggggucugcagg

SEQ ID NO: 1896 - RNA, 20 nt, Homo sapiens
ccugcagaccccgacccgcg

SEQ ID NO: 1897 - RNA, 21 nt, Homo sapiens
ucaccugagcucccgugccug

SEQ ID NO: 1898 - RNA, 21 nt, Homo sapiens
caggcacgggagcucagguga

SEQ ID NO: 1899 - RNA, 20 nt, Homo sapiens
aggcaugggaggucagguga

SEQ ID NO: 1900 - RNA, 20 nt, Homo sapiens
ucaccugaccucccaugccu

SEQ ID NO: 1901 - RNA, 23 nt, Homo sapiens
caucagcacccuauguccuuucu

SEQ ID NO: 1902 - RNA, 23 nt, Homo sapiens
agaaaggacauagggugcugaug

SEQ ID NO: 1903 - RNA, 22 nt, Homo sapiens
aaagacauaguugcaagauggg

SEQ ID NO: 1904 - RNA, 22 nt, Homo sapiens
cccaucuugcaacuaugucuuu

SEQ ID NO: 1905 - RNA, 22 nt, Homo sapiens
uuugugaccugguccacuaacc

SEQ ID NO: 1906 - RNA, 22 nt, Homo sapiens
gguuaguggaccaggucacaaa

SEQ ID NO: 1907 - RNA, 22 nt, Homo sapiens
gaugguugaccagagagcacac

SEQ ID NO: 1908 - RNA, 22 nt, Homo sapiens
gugugcucucuggucaaccauc

SEQ ID NO: 1909 - RNA, 20 nt, Homo sapiens
aaaagcuggguugagagggu

SEQ ID NO: 1910 - RNA, 20 nt, Homo sapiens
acccucucaacccagcuuuu

SEQ ID NO: 1911 - RNA, 21 nt, Homo sapiens
cacaagguauugguauuaccu

SEQ ID NO: 1912 - RNA, 21 nt, Homo sapiens
agguaauaccaauaccuugug

SEQ ID NO: 1913 - RNA, 22 nt, Homo sapiens
uaguaccaguaccuuguguuca

SEQ ID NO: 1914 - RNA, 22 nt, Homo sapiens
ugaacacaagguacugguacua

SEQ ID NO: 1915 - RNA, 22 nt, Homo sapiens
aguauucuguaccagggaaggu

SEQ ID NO: 1916 - RNA, 22 nt, Homo sapiens
accuucccugguacagaauacu

SEQ ID NO: 1917 - RNA, 22 nt, Homo sapiens
uggcaguguauuguuagcuggu

SEQ ID NO: 1918 - RNA, 22 nt, Homo sapiens
accagcuaacaauacacugcca

SEQ ID NO: 1919 - RNA, 22 nt, Homo sapiens
uauacaagggcaagcucucugu

SEQ ID NO: 1920 - RNA, 22 nt, Homo sapiens
acagagagcuugcccuuguaua

SEQ ID NO: 1921 - RNA, 22 nt, Homo sapiens
agcgagguugcccuuuguauau

SEQ ID NO: 1922 - RNA, 22 nt, Homo sapiens
auauacaaagggcaaccucgcu

SEQ ID NO: 1923 - RNA, 22 nt, Homo sapiens
caaucacuaacuccacugccau

SEQ ID NO: 1924 - RNA, 22 nt, Homo sapiens
auggcaguggaguuagugauug

SEQ ID NO: 1925 - RNA, 23 nt, Homo sapiens
uaggcagugucauuagcugauug

SEQ ID NO: 1926 - RNA, 23 nt, Homo sapiens
caaucagcuaaugacacugccua

SEQ ID NO: 1927 - RNA, 22 nt, Homo sapiens
cagccacaacuacccugccacu

SEQ ID NO: 1928 - RNA, 22 nt, Homo sapiens
aguggcaggguaguuguggcug

SEQ ID NO: 1929 - RNA, 22 nt, Homo sapiens
aggcaguguauuguuagcuggc

SEQ ID NO: 1930 - RNA, 22 nt, Homo sapiens
gccagcuaacaauacacugccu

SEQ ID NO: 1931 - RNA, 22 nt, Homo sapiens
aaucacuaaccacacggccagg

SEQ ID NO: 1932 - RNA, 22 nt, Homo sapiens
ccuggccgugugguuagugauu

SEQ ID NO: 1933 - RNA, 23 nt, Homo sapiens
aggcaguguaguuagcugauugc

SEQ ID NO: 1934 - RNA, 23 nt, Homo sapiens
gcaaucagcuaacuacacugccu

SEQ ID NO: 1935 - RNA, 20 nt, Homo sapiens
guccgcucggcgguggccca

SEQ ID NO: 1936 - RNA, 20 nt, Homo sapiens
ugggccaccgccgagcggac

SEQ ID NO: 1937 - RNA, 23 nt, Homo sapiens
gaacgccuguucuugccaggugg

SEQ ID NO: 1938 - RNA, 23 nt, Homo sapiens
ccaccuggcaagaacaggcguuc

SEQ ID NO: 1939 - RNA, 19 nt, Homo sapiens
aagugugcagggcacuggu

SEQ ID NO: 1940 - RNA, 19 nt, Homo sapiens
accagugcccugcacacuu

SEQ ID NO: 1941 - RNA, 21 nt, Homo sapiens
aggggugcuaucugugauuga

SEQ ID NO: 1942 - RNA, 21 nt, Homo sapiens
ucaaucacagauagcaccccu

SEQ ID NO: 1943 - RNA, 22 nt, Homo sapiens
cuuucagucagauguuugcugc

SEQ ID NO: 1944 - RNA, 22 nt, Homo sapiens
gcagcaaacaucugacugaaag

SEQ ID NO: 1945 - RNA, 22 nt, Homo sapiens
uguaaacauccccgacuggaag

SEQ ID NO: 1946 - RNA, 22 nt, Homo sapiens
cuuccagucggggauguuuaca

SEQ ID NO: 1947 - RNA, 22 nt, Homo sapiens
uguaaacauccucgacuggaag

SEQ ID NO: 1948 - RNA, 22 nt, Homo sapiens
cuuccagucgaggauguuuaca

SEQ ID NO: 1949 - RNA, 22 nt, Homo sapiens
agaaguaauugcgguuuugcca

SEQ ID NO: 1950 - RNA, 22 nt, Homo sapiens
uggcaaaaccgcaauuacuucu

SEQ ID NO: 1951 - RNA, 22 nt, Homo sapiens
caaaacuggcaauuacuuuugc

SEQ ID NO: 1952 - RNA, 22 nt, Homo sapiens
gcaaaaguaauugccaguuuug

SEQ ID NO: 1953 - RNA, 22 nt, Homo sapiens
aaaaguaauugcgaguuuuacc

SEQ ID NO: 1954 - RNA, 22 nt, Homo sapiens
gguaaaacucgcaauuacuuuu

SEQ ID NO: 1955 - RNA, 22 nt, Homo sapiens
caagaaccucaguugcuuuugu

SEQ ID NO: 1956 - RNA, 22 nt, Homo sapiens
acaaaagcaacugagguucuug

SEQ ID NO: 1957 - RNA, 22 nt, Homo sapiens
caaaaaucucaauuacuuuugc

SEQ ID NO: 1958 - RNA, 22 nt, Homo sapiens
gcaaaaguaauugagauuuuug

SEQ ID NO: 1959 - RNA, 22 nt, Homo sapiens
caaaaaccacaguuucuuuugc

SEQ ID NO: 1960 - RNA, 22 nt, Homo sapiens
gcaaaagaaacugugguuuuug

SEQ ID NO: 1961 - RNA, 22 nt, Homo sapiens
aaaaguaauugugguuuuugcc

SEQ ID NO: 1962 - RNA, 22 nt, Homo sapiens
ggcaaaaaccacaauuacuuuu

SEQ ID NO: 1963 - RNA, 21 nt, Homo sapiens
ugacaacuauggaugagcucu

SEQ ID NO: 1964 - RNA, 21 nt, Homo sapiens
agagcucauccauaguuguca

SEQ ID NO: 1965 - RNA, 21 nt, Homo sapiens
aacaggugacugguuagacaa

SEQ ID NO: 1966 - RNA, 21 nt, Homo sapiens
uugucuaaccagucaccuguu

SEQ ID NO: 1967 - RNA, 21 nt, Homo sapiens
aaaacggugagauuuuguuuu

SEQ ID NO: 1968 - RNA, 21 nt, Homo sapiens
aaaacaaaaucucaccguuuu

SEQ ID NO: 1969 - RNA, 21 nt, Homo sapiens
gcuaguccugacucagccagu

SEQ ID NO: 1970 - RNA, 21 nt, Homo sapiens
acuggcugagucaggacuagc

SEQ ID NO: 1971 - RNA, 21 nt, Homo sapiens
aggguaagcugaaccucugau

SEQ ID NO: 1972 - RNA, 21 nt, Homo sapiens
aucagagguucagcuuacccu

SEQ ID NO: 1973 - RNA, 22 nt, Homo sapiens
auauuaccauuagcucaucuuu

SEQ ID NO: 1974 - RNA, 22 nt, Homo sapiens
aaagaugagcuaaugguaauau

SEQ ID NO: 1975 - RNA, 22 nt, Homo sapiens
gaugagcucauuguaauaugag

SEQ ID NO: 1976 - RNA, 22 nt, Homo sapiens
cucauauuacaaugagcucauc

SEQ ID NO: 1977 - RNA, 19 nt, Homo sapiens
agguugacauacguuuccc

SEQ ID NO: 1978 - RNA, 19 nt, Homo sapiens
gggaaacguaugucaaccu

SEQ ID NO: 1979 - RNA, 20 nt, Homo sapiens
auguauaaauguauacacac

SEQ ID NO: 1980 - RNA, 20 nt, Homo sapiens
guguguauacauuuauacau

SEQ ID NO: 1981 - RNA, 24 nt, Homo sapiens
cugaagugauguguaacugaucag

SEQ ID NO: 1982 - RNA, 24 nt, Homo sapiens
cugaucaguuacacaucacuucag

SEQ ID NO: 1983 - RNA, 22 nt, Homo sapiens
aagauguggaaaaauuggaauc

SEQ ID NO: 1984 - RNA, 22 nt, Homo sapiens
gauuccaauuuuuccacaucuu

SEQ ID NO: 1985 - RNA, 21 nt, Homo sapiens
uagauaaaauauugguaccug

SEQ ID NO: 1986 - RNA, 21 nt, Homo sapiens
cagguaccaauauuuuaucua

SEQ ID NO: 1987 - RNA, 21 nt, Homo sapiens
cuucuugugcucuaggauugu

SEQ ID NO: 1988 - RNA, 21 nt, Homo sapiens
acaauccuagagcacaagaag

SEQ ID NO: 1989 - RNA, 22 nt, Homo sapiens
uaugcauuguauuuuuaggucc

SEQ ID NO: 1990 - RNA, 22 nt, Homo sapiens
ggaccuaaaaauacaaugcaua

SEQ ID NO: 1991 - RNA, 21 nt, Homo sapiens
uuuccauaggugaugagucac

SEQ ID NO: 1992 - RNA, 21 nt, Homo sapiens
gugacucaucaccuauggaaa

SEQ ID NO: 1993 - RNA, 21 nt, Homo sapiens
uuggccacaauggguuagaac

SEQ ID NO: 1994 - RNA, 21 nt, Homo sapiens
guucuaacccauuguggccaa

SEQ ID NO: 1995 - RNA, 22 nt, Homo sapiens
ugugucacucgaugaccacugu

SEQ ID NO: 1996 - RNA, 22 nt, Homo sapiens
acaguggucaucgagugacaca

SEQ ID NO: 1997 - RNA, 23 nt, Homo sapiens
acuuacagacaagagccuugcuc

SEQ ID NO: 1998 - RNA, 23 nt, Homo sapiens
gagcaaggcucuugucuguaagu

SEQ ID NO: 1999 - RNA, 19 nt, Homo sapiens
aggcugcggaauucaggac

SEQ ID NO: 2000 - RNA, 19 nt, Homo sapiens
guccugaauuccgcagccu

SEQ ID NO: 2001 - RNA, 23 nt, Homo sapiens
uaaaucccauggugccuucuccu

SEQ ID NO: 2002 - RNA, 23 nt, Homo sapiens
aggagaaggcaccaugggauuua

SEQ ID NO: 2003 - RNA, 21 nt, Homo sapiens
aaacuacugaaaaucaaagau

SEQ ID NO: 2004 - RNA, 21 nt, Homo sapiens
aucuuugauuuucaguaguuu

SEQ ID NO: 2005 - RNA, 21 nt, Homo sapiens
guucaaauccagaucuauaac

SEQ ID NO: 2006 - RNA, 21 nt, Homo sapiens
guuauagaucuggauuugaac

SEQ ID NO: 2007 - RNA, 19 nt, Homo sapiens
ccgguuccagucccuggag

SEQ ID NO: 2008 - RNA, 19 nt, Homo sapiens
cuccagggacuggaaccgg

SEQ ID NO: 2009 - RNA, 20 nt, Homo sapiens
aggguguuucucucaucucu

SEQ ID NO: 2010 - RNA, 20 nt, Homo sapiens
agagaugagagaaacacccu

SEQ ID NO: 2011 - RNA, 24 nt, Homo sapiens
gaccuggacauguuugugcccagu

SEQ ID NO: 2012 - RNA, 24 nt, Homo sapiens
acugggcacaaacauguccagguc

SEQ ID NO: 2013 - RNA, 20 nt, Homo sapiens
auggagauagauauagaaau

SEQ ID NO: 2014 - RNA, 20 nt, Homo sapiens
auuucuauaucuaucuccau

SEQ ID NO: 2015 - RNA, 19 nt, Homo sapiens
agcugucugaaaaugucuu

SEQ ID NO: 2016 - RNA, 19 nt, Homo sapiens
aagacauuuucagacagcu

SEQ ID NO: 2017 - RNA, 21 nt, Homo sapiens
agaccuggcccagaccucagc

SEQ ID NO: 2018 - RNA, 21 nt, Homo sapiens
gcugaggucugggccaggucu

SEQ ID NO: 2019 - RNA, 23 nt, Homo sapiens
acuugggcacugaaacaaugucc

SEQ ID NO: 2020 - RNA, 23 nt, Homo sapiens
ggacauuguuucagugcccaagu

SEQ ID NO: 2021 - RNA, 24 nt, Homo sapiens
acugggggcuuucgggcucugcgu

SEQ ID NO: 2022 - RNA, 24 nt, Homo sapiens
acgcagagcccgaaagcccccagu

SEQ ID NO: 2023 - RNA, 23 nt, Homo sapiens
aucgcugcgguugcgagcgcugu

SEQ ID NO: 2024 - RNA, 23 nt, Homo sapiens
acagcgcucgcaaccgcagcgau

SEQ ID NO: 2025 - RNA, 22 nt, Homo sapiens
gucccucuccaaaugugucuug

SEQ ID NO: 2026 - RNA, 22 nt, Homo sapiens
caagacacauuuggagagggac

SEQ ID NO: 2027 - RNA, 22 nt, Homo sapiens
acuuguaugcuagcucagguag

SEQ ID NO: 2028 - RNA, 22 nt, Homo sapiens
cuaccugagcuagcauacaagu

SEQ ID NO: 2029 - RNA, 22 nt, Homo sapiens
uuuaggauaagcuugacuuuug

SEQ ID NO: 2030 - RNA, 22 nt, Homo sapiens
caaaagucaagcuuauccuaaa

SEQ ID NO: 2031 - RNA, 21 nt, Homo sapiens
guguugaaacaaucucuacug

SEQ ID NO: 2032 - RNA, 21 nt, Homo sapiens
caguagagauuguuucaacac

SEQ ID NO: 2033 - RNA, 22 nt, Homo sapiens
uaugucugcugaccaucaccuu

SEQ ID NO: 2034 - RNA, 22 nt, Homo sapiens
aaggugauggucagcagacaua

SEQ ID NO: 2035 - RNA, 22 nt, Homo sapiens
ggggcuggggccggggccgagc

SEQ ID NO: 2036 - RNA, 22 nt, Homo sapiens
gcucggccccggccccagcccc

SEQ ID NO: 2037 - RNA, 22 nt, Homo sapiens
ugagguaguagguuguaugguu

SEQ ID NO: 2038 - RNA, 22 nt, Homo sapiens
aaccauacaaccuacuaccuca

SEQ ID NO: 2039 - RNA, 21 nt, Homo sapiens
gugucuuuugcucugcaguca

SEQ ID NO: 2040 - RNA, 21 nt, Homo sapiens
ugacugcagagcaaaagacac

SEQ ID NO: 2041 - RNA, 24 nt, Homo sapiens
ccccgggaacgucgagacuggagc

SEQ ID NO: 2042 - RNA, 24 nt, Homo sapiens
gcuccagucucgacguucccgggg

SEQ ID NO: 2043 - RNA, 22 nt, Homo sapiens
acccgucccguucguccccgga

SEQ ID NO: 2044 - RNA, 22 nt, Homo sapiens
uccggggacgaacgggacgggu

SEQ ID NO: 2045 - RNA, 22 nt, Homo sapiens
augggugaauuuguagaaggau

SEQ ID NO: 2046 - RNA, 22 nt, Homo sapiens
auccuucuacaaauucacccau

SEQ ID NO: 2047 - RNA, 22 nt, Homo sapiens
cuggacugagccgugcuacugg

SEQ ID NO: 2048 - RNA, 22 nt, Homo sapiens
ccaguagcacggcucaguccag

SEQ ID NO: 2049 - RNA, 22 nt, Homo sapiens
cuggacugagccaugcuacugg

SEQ ID NO: 2050 - RNA, 22 nt, Homo sapiens
ccaguagcauggcucaguccag

SEQ ID NO: 2051 - RNA, 22 nt, Homo sapiens
uacguagauauauauguauuuu

SEQ ID NO: 2052 - RNA, 22 nt, Homo sapiens
aaaauacauauauaucuacgua

SEQ ID NO: 2053 - RNA, 24 nt, Homo sapiens
aaauauauauauauauguacguau

SEQ ID NO: 2054 - RNA, 22 nt, Homo sapiens
gcucuuuucauuaauguagaca

SEQ ID NO: 2055 - RNA, 22 nt, Homo sapiens
ugcuggaucagugguucgaguc

SEQ ID NO: 2056 - RNA, 22 nt, Homo sapiens
gacucgaaccacugauccagca

SEQ ID NO: 2057 - RNA, 19 nt, Homo sapiens
uggauuuuuggaucaggga

SEQ ID NO: 2058 - RNA, 19 nt, Homo sapiens
ucccugauccaaaaaucca

SEQ ID NO: 2059 - RNA, 22 nt, Homo sapiens
uuauaaagcaaugagacugauu

SEQ ID NO: 2060 - RNA, 22 nt, Homo sapiens
aaucagucucauugcuuuauaa

SEQ ID NO: 2061 - RNA, 23 nt, Homo sapiens
uagugcaauauugcuuauagggu

SEQ ID NO: 2062 - RNA, 23 nt, Homo sapiens
acccuauaagcaauauugcacua

SEQ ID NO: 2063 - RNA, 22 nt, Homo sapiens
acccuaucaauauugucucugc

SEQ ID NO: 2064 - RNA, 22 nt, Homo sapiens
gcagagacaauauugauagggu

SEQ ID NO: 2065 - RNA, 17 nt, Homo sapiens
uaagugcuuccaugcuu

SEQ ID NO: 2066 - RNA, 17 nt, Homo sapiens
aagcauggaagcacuua

SEQ ID NO: 2067 - RNA, 22 nt, Homo sapiens
ucggccugaccacccaccccac

SEQ ID NO: 2068 - RNA, 22 nt, Homo sapiens
gugggguggguggucaggccga

SEQ ID NO: 2069 - RNA, 21 nt, Homo sapiens
ggggggggggggggggggccg

SEQ ID NO: 2070 - RNA, 21 nt, Homo sapiens
cggcccccccccccccccccc

SEQ ID NO: 2071 - RNA, 22 nt, Homo sapiens
cuauacgaccugcugccuuucu

SEQ ID NO: 2072 - RNA, 22 nt, Homo sapiens
agaaaggcagcaggucguauag

SEQ ID NO: 2073 - RNA, 22 nt, Homo sapiens
agagguaguagguugcauaguu

SEQ ID NO: 2074 - RNA, 22 nt, Homo sapiens
aacuaugcaaccuacuaccucu

SEQ ID NO: 2075 - RNA, 22 nt, Homo sapiens
ccgcacuguggguacuugcugc

SEQ ID NO: 2076 - RNA, 22 nt, Homo sapiens
gcagcaaguacccacagugcgg

SEQ ID NO: 2077 - RNA, 21 nt, Homo sapiens
uaaagugcugacagugcagau

SEQ ID NO: 2078 - RNA, 21 nt, Homo sapiens
aucugcacugucagcacuuua

SEQ ID NO: 2079 - RNA, 22 nt, Homo sapiens
aacuggaucaauuauaggagug

SEQ ID NO: 2080 - RNA, 22 nt, Homo sapiens
cacuccuauaauugauccaguu

SEQ ID NO: 2081 - RNA, 26 nt, Homo sapiens
aaguaguugguuuguaugagaugguu

SEQ ID NO: 2082 - RNA, 26 nt, Homo sapiens
aaccaucucauacaaaccaacuacuu

SEQ ID NO: 2083 - RNA, 21 nt, Homo sapiens
aagugaucuaaaggccuacau

SEQ ID NO: 2084 - RNA, 21 nt, Homo sapiens
auguaggccuuuagaucacuu

SEQ ID NO: 2085 - RNA, 22 nt, Homo sapiens
ucagaugaucuaaaggccuaua

SEQ ID NO: 2086 - RNA, 22 nt, Homo sapiens
uauaggccuuuagaucaucuga

SEQ ID NO: 2087 - RNA, 21 nt, Homo sapiens
uaggccuuuagaucacuuaaa

SEQ ID NO: 2088 - RNA, 21 nt, Homo sapiens
uuuaagugaucuaaaggccua

SEQ ID NO: 2089 - RNA, 21 nt, Homo sapiens
acucuagcugccaaaggcgcu

SEQ ID NO: 2090 - RNA, 21 nt, Homo sapiens
agcgccuuuggcagcuagagu

SEQ ID NO: 2091 - RNA, 22 nt, Homo sapiens
agaaggaaauugaauucauuua

SEQ ID NO: 2092 - RNA, 22 nt, Homo sapiens
uaaaugaauucaauuuccuucu

SEQ ID NO: 2093 - RNA, 21 nt, Homo sapiens
agagaagaagaucagccugca

SEQ ID NO: 2094 - RNA, 21 nt, Homo sapiens
ugcaggcugaucuucuucucu

SEQ ID NO: 2095 - RNA, 24 nt, Homo sapiens
agccuggaagcuggagccugcagu

SEQ ID NO: 2096 - RNA, 24 nt, Homo sapiens
acugcaggcuccagcuuccaggcu

SEQ ID NO: 2097 - RNA, 23 nt, Homo sapiens
aggaugagcaaagaaaguagauu

SEQ ID NO: 2098 - RNA, 23 nt, Homo sapiens
aaucuacuuucuuugcucauccu

SEQ ID NO: 2099 - RNA, 22 nt, Homo sapiens
aaccacuuucuuugcucaucca

SEQ ID NO: 2100 - RNA, 22 nt, Homo sapiens
uggaugagcaaagaaagugguu

SEQ ID NO: 2101 - RNA, 22 nt, Homo sapiens
cggaugagcaaagaaagugguu

SEQ ID NO: 2102 - RNA, 22 nt, Homo sapiens
aaccacuuucuuugcucauccg

SEQ ID NO: 2103 - RNA, 22 nt, Homo sapiens
aggcauugacuucucacuagcu

SEQ ID NO: 2104 - RNA, 22 nt, Homo sapiens
agcuagugagaagucaaugccu

SEQ ID NO: 2105 - RNA, 21 nt, Homo sapiens
agugaaugauggguucugacc

SEQ ID NO: 2106 - RNA, 21 nt, Homo sapiens
ggucagaacccaucauucacu

SEQ ID NO: 2107 - RNA, 21 nt, Homo sapiens
aguuaggauuaggucguggaa

SEQ ID NO: 2108 - RNA, 21 nt, Homo sapiens
uuccacgaccuaauccuaacu

SEQ ID NO: 2109 - RNA, 19 nt, Homo sapiens
auggauaaggcuuuggcuu

SEQ ID NO: 2110 - RNA, 19 nt, Homo sapiens
aagccaaagccuuauccau

SEQ ID NO: 2111 - RNA, 22 nt, Homo sapiens
augguacccuggcauacugagu

SEQ ID NO: 2112 - RNA, 22 nt, Homo sapiens
acucaguaugccaggguaccau

SEQ ID NO: 2113 - RNA, 23 nt, Homo sapiens
caagucuuauuugagcaccuguu

SEQ ID NO: 2114 - RNA, 23 nt, Homo sapiens
aacaggugcucaaauaagacuug

SEQ ID NO: 2115 - RNA, 22 nt, Homo sapiens
caggauguggucaaguguuguu

SEQ ID NO: 2116 - RNA, 22 nt, Homo sapiens
aacaacacuugaccacauccug

SEQ ID NO: 2117 - RNA, 23 nt, Homo sapiens
ccucagggcuguagaacagggcu

SEQ ID NO: 2118 - RNA, 23 nt, Homo sapiens
agcccuguucuacagcccugagg

SEQ ID NO: 2119 - RNA, 21 nt, Homo sapiens
ccuguugaaguguaaucccca

SEQ ID NO: 2120 - RNA, 21 nt, Homo sapiens
uggggauuacacuucaacagg

SEQ ID NO: 2121 - RNA, 18 nt, Homo sapiens
cgggcguggugguggggg

SEQ ID NO: 2122 - RNA, 18 nt, Homo sapiens
cccccaccaccacgcccg

SEQ ID NO: 2123 - RNA, 20 nt, Homo sapiens
cgggcgugguggugggggug

SEQ ID NO: 2124 - RNA, 20 nt, Homo sapiens
cacccccaccaccacgcccg

SEQ ID NO: 2125 - RNA, 23 nt, Homo sapiens
cuggagauauggaagagcugugu

SEQ ID NO: 2126 - RNA, 23 nt, Homo sapiens
acacagcucuuccauaucuccag

SEQ ID NO: 2127 - RNA, 26 nt, Homo sapiens
gaugaugauggcagcaaauucugaaa

SEQ ID NO: 2128 - RNA, 26 nt, Homo sapiens
uuucagaauuugcugccaucaucauc

SEQ ID NO: 2129 - RNA, 25 nt, Homo sapiens
gggcgacaaagcaagacucuuucuu

SEQ ID NO: 2130 - RNA, 25 nt, Homo sapiens
aagaaagagucuugcuuugucgccc

SEQ ID NO: 2131 - RNA, 25 nt, Homo sapiens
gaacccaugagguugaggcugcagu

SEQ ID NO: 2132 - RNA, 25 nt, Homo sapiens
acugcagccucaaccucauggguuc

SEQ ID NO: 2133 - RNA, 17 nt, Homo sapiens
gugggggagaggcuguc

SEQ ID NO: 2134 - RNA, 17 nt, Homo sapiens
gacagccucucccccac

SEQ ID NO: 2135 - RNA, 20 nt, Homo sapiens
uaaagagcccuguggagaca

SEQ ID NO: 2136 - RNA, 20 nt, Homo sapiens
ugucuccacagggcucuuua

SEQ ID NO: 2137 - RNA, 22 nt, Homo sapiens
uaguacugugcauaucaucuau

SEQ ID NO: 2138 - RNA, 22 nt, Homo sapiens
auagaugauaugcacaguacua

SEQ ID NO: 2139 - RNA, 20 nt, Homo sapiens
ucguuugccuuuuucugcuu

SEQ ID NO: 2140 - RNA, 20 nt, Homo sapiens
aagcagaaaaaggcaaacga

SEQ ID NO: 2141 - RNA, 21 nt, Homo sapiens
uggacugcccugaucuggaga

SEQ ID NO: 2142 - RNA, 21 nt, Homo sapiens
ucuccagaucagggcagucca

SEQ ID NO: 2143 - RNA, 22 nt, Homo sapiens
uggguggucuggagauuugugc

SEQ ID NO: 2144 - RNA, 22 nt, Homo sapiens
gcacaaaucuccagaccaccca

SEQ ID NO: 2145 - RNA, 22 nt, Homo sapiens
ugugagguuggcauuguugucu

SEQ ID NO: 2146 - RNA, 22 nt, Homo sapiens
agacaacaaugccaaccucaca

SEQ ID NO: 2147 - RNA, 17 nt, Homo sapiens
uucaaguaauucaggug

SEQ ID NO: 2148 - RNA, 17 nt, Homo sapiens
caccugaauuacuugaa

SEQ ID NO: 2149 - RNA, 22 nt, Homo sapiens
uucuggaauucugugugaggga

SEQ ID NO: 2150 - RNA, 22 nt, Homo sapiens
ucccucacacagaauuccagaa

SEQ ID NO: 2151 - RNA, 22 nt, Homo sapiens
uuuucaacucuaaugggagaga

SEQ ID NO: 2152 - RNA, 22 nt, Homo sapiens
ucucucccauuagaguugaaaa

SEQ ID NO: 2153 - RNA, 18 nt, Homo sapiens
acguuggcucugguggug

SEQ ID NO: 2154 - RNA, 18 nt, Homo sapiens
caccaccagagccaacgu

SEQ ID NO: 2155 - RNA, 22 nt, Homo sapiens
ccaccuccccugcaaacgucca

SEQ ID NO: 2156 - RNA, 22 nt, Homo sapiens
uggacguuugcaggggaggugg

SEQ ID NO: 2157 - RNA, 22 nt, Homo sapiens
acucggcguggcgucggucgug

SEQ ID NO: 2158 - RNA, 22 nt, Homo sapiens
cacgaccgacgccacgccgagu

SEQ ID NO: 2159 - RNA, 21 nt, Homo sapiens
ucgaccggaccucgaccggcu

SEQ ID NO: 2160 - RNA, 21 nt, Homo sapiens
agccggucgagguccggucga

SEQ ID NO: 2161 - RNA, 22 nt, Homo sapiens
ugagaacugaauuccauaggcu

SEQ ID NO: 2162 - RNA, 22 nt, Homo sapiens
agccuauggaauucaguucuca

SEQ ID NO: 2163 - RNA, 22 nt, Homo sapiens
aaucauacacgguugaccuauu

SEQ ID NO: 2164 - RNA, 22 nt, Homo sapiens
aauaggucaaccguguaugauu

SEQ ID NO: 2165 - RNA, 22 nt, Homo sapiens
uagguuauccguguugccuucg

SEQ ID NO: 2166 - RNA, 22 nt, Homo sapiens
cgaaggcaacacggauaaccua

SEQ ID NO: 2167 - RNA, 21 nt, Homo sapiens
ccaguccugugccugccgccu

SEQ ID NO: 2168 - RNA, 21 nt, Homo sapiens
aggcggcaggcacaggacugg

SEQ ID NO: 2169 - RNA, 22 nt, Homo sapiens
ucugcccccuccgcugcugcca

SEQ ID NO: 2170 - RNA, 22 nt, Homo sapiens
uggcagcagcggagggggcaga

SEQ ID NO: 2171 - RNA, 22 nt, Homo sapiens
ggaggggucccgcacugggagg

SEQ ID NO: 2172 - RNA, 22 nt, Homo sapiens
ccucccagugcgggaccccucc

SEQ ID NO: 2173 - RNA, 22 nt, Homo sapiens
cccugugcccggcccacuucug

SEQ ID NO: 2174 - RNA, 22 nt, Homo sapiens
cagaagugggccgggcacaggg

SEQ ID NO: 2175 - RNA, 20 nt, Homo sapiens
ccccagggcgacgcggcggg

SEQ ID NO: 2176 - RNA, 20 nt, Homo sapiens
cccgccgcgucgcccugggg

SEQ ID NO: 2177 - RNA, 22 nt, Homo sapiens
accuugccuugcugcccgggcc

SEQ ID NO: 2178 - RNA, 22 nt, Homo sapiens
ggcccgggcagcaaggcaaggu

SEQ ID NO: 2179 - RNA, 21 nt, Homo sapiens
auuugugcuuggcucugucac

SEQ ID NO: 2180 - RNA, 21 nt, Homo sapiens
gugacagagccaagcacaaau

SEQ ID NO: 2181 - RNA, 22 nt, Homo sapiens
auuguccuugcuguuuggagau

SEQ ID NO: 2182 - RNA, 22 nt, Homo sapiens
aucuccaaacagcaaggacaau

SEQ ID NO: 2183 - RNA, 21 nt, Homo sapiens
auccccagauacaauggacaa

SEQ ID NO: 2184 - RNA, 21 nt, Homo sapiens
uuguccauuguaucuggggau

SEQ ID NO: 2185 - RNA, 23 nt, Homo sapiens
cagugcaauaguauugucaaagc

SEQ ID NO: 2186 - RNA, 23 nt, Homo sapiens
gcuuugacaauacuauugcacug

SEQ ID NO: 2187 - RNA, 22 nt, Homo sapiens
gcucugacuuuauugcacuacu

SEQ ID NO: 2188 - RNA, 22 nt, Homo sapiens
aguagugcaauaaagucagagc

SEQ ID NO: 2189 - RNA, 23 nt, Homo sapiens
uaagugcuuccauguuuuaguag

SEQ ID NO: 2190 - RNA, 23 nt, Homo sapiens
cuacuaaaacauggaagcacuua

SEQ ID NO: 2191 - RNA, 22 nt, Homo sapiens
acuuuaacauggaagugcuuuc

SEQ ID NO: 2192 - RNA, 22 nt, Homo sapiens
gaaagcacuuccauguuaaagu

SEQ ID NO: 2193 - RNA, 23 nt, Homo sapiens
uaagugcuuccauguuucagugg

SEQ ID NO: 2194 - RNA, 23 nt, Homo sapiens
ccacugaaacauggaagcacuua

SEQ ID NO: 2195 - RNA, 22 nt, Homo sapiens
uuuaacauggggguaccugcug

SEQ ID NO: 2196 - RNA, 22 nt, Homo sapiens
cagcagguacccccauguuaaa

SEQ ID NO: 2197 - RNA, 23 nt, Homo sapiens
uaagugcuuccauguuugagugu

SEQ ID NO: 2198 - RNA, 23 nt, Homo sapiens
acacucaaacauggaagcacuua

SEQ ID NO: 2199 - RNA, 22 nt, Homo sapiens
acuuuaacauggaggcacuugc

SEQ ID NO: 2200 - RNA, 22 nt, Homo sapiens
gcaagugccuccauguuaaagu

SEQ ID NO: 2201 - RNA, 22 nt, Homo sapiens
aauugcacuuuagcaaugguga

SEQ ID NO: 2202 - RNA, 22 nt, Homo sapiens
ucaccauugcuaaagugcaauu

SEQ ID NO: 2203 - RNA, 22 nt, Homo sapiens
acuguugcuaauaugcaacucu

SEQ ID NO: 2204 - RNA, 22 nt, Homo sapiens
agaguugcauauuagcaacagu

SEQ ID NO: 2205 - RNA, 23 nt, Homo sapiens
agcucggucugaggccccucagu

SEQ ID NO: 2206 - RNA, 23 nt, Homo sapiens
acugaggggccucagaccgagcu

SEQ ID NO: 2207 - RNA, 22 nt, Homo sapiens
aaaaacugagacuacuuuugca

SEQ ID NO: 2208 - RNA, 22 nt, Homo sapiens
ugcaaaaguagucucaguuuuu

SEQ ID NO: 2209 - RNA, 19 nt, Homo sapiens
aaaaacuguaauuacuuuu

SEQ ID NO: 2210 - RNA, 19 nt, Homo sapiens
aaaaguaauuacaguuuuu

SEQ ID NO: 2211 - RNA, 22 nt, Homo sapiens
aaaacuguaauuacuuuuguac

SEQ ID NO: 2212 - RNA, 22 nt, Homo sapiens
guacaaaaguaauuacaguuuu

SEQ ID NO: 2213 - RNA, 23 nt, Homo sapiens
ugcaaaaguaauugcaguuuuug

SEQ ID NO: 2214 - RNA, 23 nt, Homo sapiens
caaaaacugcaauuacuuuugca

SEQ ID NO: 2215 - RNA, 23 nt, Homo sapiens
caaaaaccgcaauuacuuuugca

SEQ ID NO: 2216 - RNA, 23 nt, Homo sapiens
ugcaaaaguaauugcgguuuuug

SEQ ID NO: 2217 - RNA, 22 nt, Homo sapiens
aaaaguaaucgcgguuuuuguc

SEQ ID NO: 2218 - RNA, 22 nt, Homo sapiens
gacaaaaaccgcgauuacuuuu

SEQ ID NO: 2219 - RNA, 22 nt, Homo sapiens
aaaaguacuugcggauuuugcu

SEQ ID NO: 2220 - RNA, 22 nt, Homo sapiens
agcaaaauccgcaaguacuuuu

SEQ ID NO: 2221 - RNA, 22 nt, Homo sapiens
aaaaguauuugcggguuuuguc

SEQ ID NO: 2222 - RNA, 22 nt, Homo sapiens
gacaaaacccgcaaauacuuuu

SEQ ID NO: 2223 - RNA, 21 nt, Homo sapiens
caaagguauuugugguuuuug

SEQ ID NO: 2224 - RNA, 21 nt, Homo sapiens
caaaaaccacaaauaccuuug

SEQ ID NO: 2225 - RNA, 22 nt, Homo sapiens
ccaaaacugcaguuacuuuugc

SEQ ID NO: 2226 - RNA, 22 nt, Homo sapiens
gcaaaaguaacugcaguuuugg

SEQ ID NO: 2227 - RNA, 22 nt, Homo sapiens
aaaaguaauugcgguuuuugcc

SEQ ID NO: 2228 - RNA, 22 nt, Homo sapiens
ggcaaaaaccgcaauuacuuuu

SEQ ID NO: 2229 - RNA, 22 nt, Homo sapiens
uagcaaaaacugcaguuacuuu

SEQ ID NO: 2230 - RNA, 22 nt, Homo sapiens
aaaguaacugcaguuuuugcua

SEQ ID NO: 2231 - RNA, 20 nt, Homo sapiens
ggagguugggaagggcagag

SEQ ID NO: 2232 - RNA, 20 nt, Homo sapiens
cucugcccuucccaaccucc

SEQ ID NO: 2233 - RNA, 18 nt, Homo sapiens
ugaggcgggggggcgagc

SEQ ID NO: 2234 - RNA, 18 nt, Homo sapiens
gcucgcccccccgccuca

SEQ ID NO: 2235 - RNA, 20 nt, Homo sapiens
agagaugaagcgggggggcg

SEQ ID NO: 2236 - RNA, 20 nt, Homo sapiens
cgcccccccgcuucaucucu

SEQ ID NO: 2237 - RNA, 24 nt, Homo sapiens
ggaggccgggguggggcggggcgg

SEQ ID NO: 2238 - RNA, 24 nt, Homo sapiens
ccgccccgccccaccccggccucc

SEQ ID NO: 2239 - RNA, 19 nt, Homo sapiens
ggggagcgaggggcggggc

SEQ ID NO: 2240 - RNA, 19 nt, Homo sapiens
gccccgccccucgcucccc

SEQ ID NO: 2241 - RNA, 23 nt, Homo sapiens
uauucauuuauccccagccuaca

SEQ ID NO: 2242 - RNA, 23 nt, Homo sapiens
uguaggcuggggauaaaugaaua

SEQ ID NO: 2243 - RNA, 24 nt, Homo sapiens
acuggcuagggaaaaugauuggau

SEQ ID NO: 2244 - RNA, 24 nt, Homo sapiens
auccaaucauuuucccuagccagu

SEQ ID NO: 2245 - RNA, 22 nt, Homo sapiens
uucauuugccucccagccuaca

SEQ ID NO: 2246 - RNA, 22 nt, Homo sapiens
uguaggcugggaggcaaaugaa

SEQ ID NO: 2247 - RNA, 24 nt, Homo sapiens
ugggcuaagggagaugauugggua

SEQ ID NO: 2248 - RNA, 24 nt, Homo sapiens
uacccaaucaucucccuuagccca

SEQ ID NO: 2249 - RNA, 22 nt, Homo sapiens
acuccagccccacagccucagc

SEQ ID NO: 2250 - RNA, 22 nt, Homo sapiens
gcugaggcuguggggcuggagu

SEQ ID NO: 2251 - RNA, 22 nt, Homo sapiens
aggaggaauuggugcuggucuu

SEQ ID NO: 2252 - RNA, 22 nt, Homo sapiens
aagaccagcaccaauuccuccu

SEQ ID NO: 2253 - RNA, 22 nt, Homo sapiens
aggcagcgggguguaguggaua

SEQ ID NO: 2254 - RNA, 22 nt, Homo sapiens
uauccacuacaccccgcugccu

SEQ ID NO: 2255 - RNA, 22 nt, Homo sapiens
uccauuacacuacccugccucu

SEQ ID NO: 2256 - RNA, 22 nt, Homo sapiens
agaggcaggguaguguaaugga

SEQ ID NO: 2257 - RNA, 22 nt, Homo sapiens
acugcugagcuagcacuucccg

SEQ ID NO: 2258 - RNA, 22 nt, Homo sapiens
cgggaagugcuagcucagcagu

SEQ ID NO: 2259 - RNA, 23 nt, Homo sapiens
caaagugcuguucgugcagguag

SEQ ID NO: 2260 - RNA, 23 nt, Homo sapiens
cuaccugcacgaacagcacuuug

SEQ ID NO: 2261 - RNA, 23 nt, Homo sapiens
cacccggcugugugcacaugugc

SEQ ID NO: 2262 - RNA, 23 nt, Homo sapiens
gcacaugugcacacagccgggug

SEQ ID NO: 2263 - RNA, 23 nt, Homo sapiens
agcuucuuuacagugcugccuug

SEQ ID NO: 2264 - RNA, 23 nt, Homo sapiens
caaggcagcacuguaaagaagcu

SEQ ID NO: 2265 - RNA, 23 nt, Homo sapiens
agcagcauuguacagggcuauga

SEQ ID NO: 2266 - RNA, 23 nt, Homo sapiens
ucauagcccuguacaaugcugcu

SEQ ID NO: 2267 - RNA, 17 nt, Homo sapiens
ccugagaaaagggccaa

SEQ ID NO: 2268 - RNA, 17 nt, Homo sapiens
uuggcccuuuucucagg

SEQ ID NO: 2269 - RNA, 19 nt, Homo sapiens
ggccacugagucagcacca

SEQ ID NO: 2270 - RNA, 19 nt, Homo sapiens
uggugcugacucaguggcc

SEQ ID NO: 2271 - RNA, 18 nt, Homo sapiens
agggcauguccagggggu

SEQ ID NO: 2272 - RNA, 18 nt, Homo sapiens
acccccuggacaugcccu

SEQ ID NO: 2273 - RNA, 23 nt, Homo sapiens
gccuggagcuacuccaccaucuc

SEQ ID NO: 2274 - RNA, 23 nt, Homo sapiens
gagaugguggaguagcuccaggc

SEQ ID NO: 2275 - RNA, 17 nt, Homo sapiens
caguguucagagaugga

SEQ ID NO: 2276 - RNA, 17 nt, Homo sapiens
uccaucucugaacacug

SEQ ID NO: 2277 - RNA, 18 nt, Homo sapiens
aucugaccugaugaaggu

SEQ ID NO: 2278 - RNA, 18 nt, Homo sapiens
accuucaucaggucagau

SEQ ID NO: 2279 - RNA, 18 nt, Homo sapiens
ccagagguggggacugag

SEQ ID NO: 2280 - RNA, 18 nt, Homo sapiens
cucaguccccaccucugg

SEQ ID NO: 2281 - RNA, 17 nt, Homo sapiens
ccccgccaccgccuugg

SEQ ID NO: 2282 - RNA, 17 nt, Homo sapiens
ccaaggcgguggcgggg

SEQ ID NO: 2283 - RNA, 22 nt, Homo sapiens
caguugggucuaggggucagga

SEQ ID NO: 2284 - RNA, 22 nt, Homo sapiens
uccugaccccuagacccaacug

SEQ ID NO: 2285 - RNA, 19 nt, Homo sapiens
cuuggggcauggaguccca

SEQ ID NO: 2286 - RNA, 19 nt, Homo sapiens
ugggacuccaugccccaag

SEQ ID NO: 2287 - RNA, 16 nt, Homo sapiens
aggaaacagggaccca

SEQ ID NO: 2288 - RNA, 16 nt, Homo sapiens
ugggucccuguuuccu

SEQ ID NO: 2289 - RNA, 17 nt, Homo sapiens
gacauucagacuaccug

SEQ ID NO: 2290 - RNA, 17 nt, Homo sapiens
cagguagucugaauguc

SEQ ID NO: 2291 - RNA, 18 nt, Homo sapiens
auucuaagugccuuggcc

SEQ ID NO: 2292 - RNA, 18 nt, Homo sapiens
ggccaaggcacuuagaau

SEQ ID NO: 2293 - RNA, 17 nt, Homo sapiens
acucagucauggucauu

SEQ ID NO: 2294 - RNA, 17 nt, Homo sapiens
aaugaccaugacugagu

SEQ ID NO: 2295 - RNA, 19 nt, Homo sapiens
cugugggcucagcucuggg

SEQ ID NO: 2296 - RNA, 19 nt, Homo sapiens
cccagagcugagcccacag

SEQ ID NO: 2297 - RNA, 16 nt, Homo sapiens
cuaggaggccuuggcc

SEQ ID NO: 2298 - RNA, 16 nt, Homo sapiens
ggccaaggccuccuag

SEQ ID NO: 2299 - RNA, 16 nt, Homo sapiens
uccagcucgguggcac

SEQ ID NO: 2300 - RNA, 16 nt, Homo sapiens
gugccaccgagcugga

SEQ ID NO: 2301 - RNA, 21 nt, Homo sapiens
ggcuccuccucucaggaugug

SEQ ID NO: 2302 - RNA, 21 nt, Homo sapiens
cacauccugagaggaggagcc

SEQ ID NO: 2303 - RNA, 21 nt, Homo sapiens
gcaggcacagacagcccuggc

SEQ ID NO: 2304 - RNA, 21 nt, Homo sapiens
gccagggcugucugugccugc

SEQ ID NO: 2305 - RNA, 20 nt, Homo sapiens
ucagggagucaggggagggc

SEQ ID NO: 2306 - RNA, 20 nt, Homo sapiens
gcccuccccugacucccuga

SEQ ID NO: 2307 - RNA, 19 nt, Homo sapiens
gggggaagaaaaggugggg

SEQ ID NO: 2308 - RNA, 19 nt, Homo sapiens
ccccaccuuuucuuccccc

SEQ ID NO: 2309 - RNA, 18 nt, Homo sapiens
cauucaacuagugauugu

SEQ ID NO: 2310 - RNA, 18 nt, Homo sapiens
acaaucacuaguugaaug

SEQ ID NO: 2311 - RNA, 18 nt, Homo sapiens
cagcagucccucccccug

SEQ ID NO: 2312 - RNA, 18 nt, Homo sapiens
cagggggagggacugcug

SEQ ID NO: 2313 - RNA, 17 nt, Homo sapiens
ccaauuaccacuucuuu

SEQ ID NO: 2314 - RNA, 17 nt, Homo sapiens
aaagaagugguaauugg

SEQ ID NO: 2315 - RNA, 17 nt, Homo sapiens
cucagugacucaugugc

SEQ ID NO: 2316 - RNA, 17 nt, Homo sapiens
gcacaugagucacugag

SEQ ID NO: 2317 - RNA, 21 nt, Homo sapiens
gcaguucugagcacaguacac

SEQ ID NO: 2318 - RNA, 21 nt, Homo sapiens
guguacugugcucagaacugc

SEQ ID NO: 2319 - RNA, 18 nt, Homo sapiens
cuaggggguuugcccuug

SEQ ID NO: 2320 - RNA, 18 nt, Homo sapiens
caagggcaaacccccuag

SEQ ID NO: 2321 - RNA, 16 nt, Homo sapiens
cucuccucccggcuuc

SEQ ID NO: 2322 - RNA, 16 nt, Homo sapiens
gaagccgggaggagag

SEQ ID NO: 2323 - RNA, 21 nt, Homo sapiens
gaguguaguucugagcagagc

SEQ ID NO: 2324 - RNA, 21 nt, Homo sapiens
gcucugcucagaacuacacuc

SEQ ID NO: 2325 - RNA, 18 nt, Homo sapiens
gggucccggggagggggg

SEQ ID NO: 2326 - RNA, 18 nt, Homo sapiens
ccccccuccccgggaccc

SEQ ID NO: 2327 - RNA, 18 nt, Homo sapiens
uaaaauuugcauccagga

SEQ ID NO: 2328 - RNA, 18 nt, Homo sapiens
uccuggaugcaaauuuua

SEQ ID NO: 2329 - RNA, 17 nt, Homo sapiens
uggggcucagcgaguuu

SEQ ID NO: 2330 - RNA, 17 nt, Homo sapiens
aaacucgcugagcccca

SEQ ID NO: 2331 - RNA, 18 nt, Homo sapiens
gggcucacaucaccccau

SEQ ID NO: 2332 - RNA, 18 nt, Homo sapiens
auggggugaugugagccc

SEQ ID NO: 2333 - RNA, 18 nt, Homo sapiens
gcggcgaguccgacucau

SEQ ID NO: 2334 - RNA, 18 nt, Homo sapiens
augagucggacucgccgc

SEQ ID NO: 2335 - RNA, 17 nt, Homo sapiens
accccacuccugguacc

SEQ ID NO: 2336 - RNA, 17 nt, Homo sapiens
gguaccaggaguggggu

SEQ ID NO: 2337 - RNA, 19 nt, Homo sapiens
ucucccuugagggcacuuu

SEQ ID NO: 2338 - RNA, 19 nt, Homo sapiens
aaagugcccucaagggaga

SEQ ID NO: 2339 - RNA, 17 nt, Homo sapiens
uugucugcugaguuucc

SEQ ID NO: 2340 - RNA, 17 nt, Homo sapiens
ggaaacucagcagacaa

SEQ ID NO: 2341 - RNA, 19 nt, Homo sapiens
gcauugugcagggcuauca

SEQ ID NO: 2342 - RNA, 19 nt, Homo sapiens
ugauagcccugcacaaugc

SEQ ID NO: 2343 - RNA, 19 nt, Homo sapiens
ugcccuccuuucuucccuc

SEQ ID NO: 2344 - RNA, 19 nt, Homo sapiens
gagggaagaaaggagggca

SEQ ID NO: 2345 - RNA, 16 nt, Homo sapiens
uucagcaggaacagcu

SEQ ID NO: 2346 - RNA, 16 nt, Homo sapiens
agcuguuccugcugaa

SEQ ID NO: 2347 - RNA, 18 nt, Homo sapiens
ccccugggccggccuugg

SEQ ID NO: 2348 - RNA, 18 nt, Homo sapiens
ccaaggccggcccagggg

SEQ ID NO: 2349 - RNA, 17 nt, Homo sapiens
cagccugacaggaacag

SEQ ID NO: 2350 - RNA, 17 nt, Homo sapiens
cuguuccugucaggcug

SEQ ID NO: 2351 - RNA, 17 nt, Homo sapiens
gggagucuacagcaggg

SEQ ID NO: 2352 - RNA, 17 nt, Homo sapiens
cccugcuguagacuccc

SEQ ID NO: 2353 - RNA, 18 nt, Homo sapiens
cagugcaauguuuuccuu

SEQ ID NO: 2354 - RNA, 18 nt, Homo sapiens
aaggaaaacauugcacug

SEQ ID NO: 2355 - RNA, 17 nt, Homo sapiens
augugggcucaggcuca

SEQ ID NO: 2356 - RNA, 17 nt, Homo sapiens
ugagccugagcccacau

SEQ ID NO: 2357 - RNA, 16 nt, Homo sapiens
ugccuuccugucugug

SEQ ID NO: 2358 - RNA, 16 nt, Homo sapiens
cacagacaggaaggca

SEQ ID NO: 2359 - RNA, 22 nt, Homo sapiens
cugggacaggaggaggaggcag

SEQ ID NO: 2360 - RNA, 22 nt, Homo sapiens
cugccuccuccuccugucccag

SEQ ID NO: 2361 - RNA, 18 nt, Homo sapiens
gcuggugacaugagaggc

SEQ ID NO: 2362 - RNA, 18 nt, Homo sapiens
gccucucaugucaccagc

SEQ ID NO: 2363 - RNA, 18 nt, Homo sapiens
ugggagcuggacuacuuc

SEQ ID NO: 2364 - RNA, 18 nt, Homo sapiens
gaaguaguccagcuccca

SEQ ID NO: 2365 - RNA, 20 nt, Homo sapiens
ucccacuacuucacuuguga

SEQ ID NO: 2366 - RNA, 20 nt, Homo sapiens
ucacaagugaaguaguggga

SEQ ID NO: 2367 - RNA, 18 nt, Homo sapiens
ccaguguggcucagcgag

SEQ ID NO: 2368 - RNA, 18 nt, Homo sapiens
cucgcugagccacacugg

SEQ ID NO: 2369 - RNA, 17 nt, Homo sapiens
uucugagcugaggacag

SEQ ID NO: 2370 - RNA, 17 nt, Homo sapiens
cuguccucagcucagaa

SEQ ID NO: 2371 - RNA, 17 nt, Homo sapiens
ccggcauguccagggca

SEQ ID NO: 2372 - RNA, 17 nt, Homo sapiens
ugcccuggacaugccgg

SEQ ID NO: 2373 - RNA, 18 nt, Homo sapiens
ccuagacaccuccaguuc

SEQ ID NO: 2374 - RNA, 18 nt, Homo sapiens
gaacuggaggugucuagg

SEQ ID NO: 2375 - RNA, 17 nt, Homo sapiens
uggagagaaaggcagua

SEQ ID NO: 2376 - RNA, 17 nt, Homo sapiens
uacugccuuucucucca

SEQ ID NO: 2377 - RNA, 19 nt, Homo sapiens
aauguuuuuuccuguuucc

SEQ ID NO: 2378 - RNA, 19 nt, Homo sapiens
ggaaacaggaaaaaacauu

SEQ ID NO: 2379 - RNA, 18 nt, Homo sapiens
ucccuggaguuucuucuu

SEQ ID NO: 2380 - RNA, 18 nt, Homo sapiens
aagaagaaacuccaggga

SEQ ID NO: 2381 - RNA, 18 nt, Homo sapiens
cuggagucuaggauucca

SEQ ID NO: 2382 - RNA, 18 nt, Homo sapiens
uggaauccuagacuccag

SEQ ID NO: 2383 - RNA, 16 nt, Homo sapiens
gcagcauucauguccc

SEQ ID NO: 2384 - RNA, 16 nt, Homo sapiens
gggacaugaaugcugc

SEQ ID NO: 2385 - RNA, 18 nt, Homo sapiens
gaaagagagcugagugug

SEQ ID NO: 2386 - RNA, 18 nt, Homo sapiens
cacacucagcucucuuuc

SEQ ID NO: 2387 - RNA, 19 nt, Homo sapiens
ggccuuguuccugucccca

SEQ ID NO: 2388 - RNA, 19 nt, Homo sapiens
uggggacaggaacaaggcc

SEQ ID NO: 2389 - RNA, 20 nt, Homo sapiens
agcccccuggccccaaaccc

SEQ ID NO: 2390 - RNA, 20 nt, Homo sapiens
ggguuuggggccagggggcu

SEQ ID NO: 2391 - RNA, 18 nt, Homo sapiens
cucugggaaaugggacag

SEQ ID NO: 2392 - RNA, 18 nt, Homo sapiens
cugucccauuucccagag

SEQ ID NO: 2393 - RNA, 18 nt, Homo sapiens
ccgcuuucugagcuggac

SEQ ID NO: 2394 - RNA, 18 nt, Homo sapiens
guccagcucagaaagcgg

SEQ ID NO: 2395 - RNA, 17 nt, Homo sapiens
ggugaggcuagcuggug

SEQ ID NO: 2396 - RNA, 17 nt, Homo sapiens
caccagcuagccucacc

SEQ ID NO: 2397 - RNA, 17 nt, Homo sapiens
acauugccagggaguuu

SEQ ID NO: 2398 - RNA, 17 nt, Homo sapiens
aaacucccuggcaaugu

SEQ ID NO: 2399 - RNA, 17 nt, Homo sapiens
cacuguggguacaugcu

SEQ ID NO: 2400 - RNA, 17 nt, Homo sapiens
agcauguacccacagug

SEQ ID NO: 2401 - RNA, 17 nt, Homo sapiens
ucccugagcaaagccac

SEQ ID NO: 2402 - RNA, 17 nt, Homo sapiens
guggcuuugcucaggga

SEQ ID NO: 2403 - RNA, 18 nt, Homo sapiens
gggauucuguagcuuccu

SEQ ID NO: 2404 - RNA, 18 nt, Homo sapiens
aggaagcuacagaauccc

SEQ ID NO: 2405 - RNA, 21 nt, Homo sapiens
uuagcgguggaccgcccugcg

SEQ ID NO: 2406 - RNA, 21 nt, Homo sapiens
cgcagggcgguccaccgcuaa

SEQ ID NO: 2407 - RNA, 21 nt, Homo sapiens
cugugggcucagcgcgugggg

SEQ ID NO: 2408 - RNA, 21 nt, Homo sapiens
ccccacgcgcugagcccacag

SEQ ID NO: 2409 - RNA, 18 nt, Homo sapiens
cagccccacagccucaga

SEQ ID NO: 2410 - RNA, 18 nt, Homo sapiens
ucugaggcuguggggcug

SEQ ID NO: 2411 - RNA, 20 nt, Homo sapiens
cccugagacccuaaccuuaa

SEQ ID NO: 2412 - RNA, 20 nt, Homo sapiens
uuaagguuagggucucaggg

SEQ ID NO: 2413 - RNA, 18 nt, Homo sapiens
uugcacuugucucaguga

SEQ ID NO: 2414 - RNA, 18 nt, Homo sapiens
ucacugagacaagugcaa

SEQ ID NO: 2415 - RNA, 20 nt, Homo sapiens
uguuccucugucucccagac

SEQ ID NO: 2416 - RNA, 20 nt, Homo sapiens
gucugggagacagaggaaca

SEQ ID NO: 2417 - RNA, 19 nt, Homo sapiens
ggcuugcaugggggacugg

SEQ ID NO: 2418 - RNA, 19 nt, Homo sapiens
ccagucccccaugcaagcc

SEQ ID NO: 2419 - RNA, 17 nt, Homo sapiens
ccaguuuucccaggauu

SEQ ID NO: 2420 - RNA, 17 nt, Homo sapiens
aauccugggaaaacugg

SEQ ID NO: 2421 - RNA, 19 nt, Homo sapiens
ccugagacccuaguuccac

SEQ ID NO: 2422 - RNA, 19 nt, Homo sapiens
guggaacuagggucucagg

SEQ ID NO: 2423 - RNA, 19 nt, Homo sapiens
ccucagaucagagccuugc

SEQ ID NO: 2424 - RNA, 19 nt, Homo sapiens
gcaaggcucugaucugagg

SEQ ID NO: 2425 - RNA, 22 nt, Homo sapiens
cauugcacuugucucggucuga

SEQ ID NO: 2426 - RNA, 22 nt, Homo sapiens
ucagaccgagacaagugcaaug

SEQ ID NO: 2427 - RNA, 21 nt, Homo sapiens
aggcggagacuugggcaauug

SEQ ID NO: 2428 - RNA, 21 nt, Homo sapiens
caauugcccaagucuccgccu

SEQ ID NO: 2429 - RNA, 22 nt, Homo sapiens
ccuauucuugguuacuugcacg

SEQ ID NO: 2430 - RNA, 22 nt, Homo sapiens
cgugcaaguaaccaagaauagg

SEQ ID NO: 2431 - RNA, 19 nt, Homo sapiens
aauggauuuuuggagcagg

SEQ ID NO: 2432 - RNA, 19 nt, Homo sapiens
ccugcuccaaaaauccauu

SEQ ID NO: 2433 - RNA, 22 nt, Homo sapiens
ugcggggcuagggcuaacagca

SEQ ID NO: 2434 - RNA, 22 nt, Homo sapiens
ugcuguuagcccuagccccgca

SEQ ID NO: 2435 - RNA, 22 nt, Homo sapiens
aaaaguaauugcggauuuugcc

SEQ ID NO: 2436 - RNA, 22 nt, Homo sapiens
ggcaaaauccgcaauuacuuuu

SEQ ID NO: 2437 - RNA, 22 nt, Homo sapiens
caaaaguaauuguggauuuugu

SEQ ID NO: 2438 - RNA, 22 nt, Homo sapiens
acaaaauccacaauuacuuuug

SEQ ID NO: 2439 - RNA, 23 nt, Homo sapiens
uaagugcuuccauguuuugguga

SEQ ID NO: 2440 - RNA, 23 nt, Homo sapiens
ucaccaaaacauggaagcacuua

SEQ ID NO: 2441 - RNA, 23 nt, Homo sapiens
acuuaaacguggauguacuugcu

SEQ ID NO: 2442 - RNA, 23 nt, Homo sapiens
agcaaguacauccacguuuaagu

SEQ ID NO: 2443 - RNA, 21 nt, Homo sapiens
cuauacaaucuacugucuuuc

SEQ ID NO: 2444 - RNA, 21 nt, Homo sapiens
gaaagacaguagauuguauag

SEQ ID NO: 2445 - RNA, 22 nt, Homo sapiens
ugagguaguagguuguauaguu

SEQ ID NO: 2446 - RNA, 22 nt, Homo sapiens
aacuauacaaccuacuaccuca

SEQ ID NO: 2447 - RNA, 22 nt, Homo sapiens
cuguacagccuccuagcuuucc

SEQ ID NO: 2448 - RNA, 22 nt, Homo sapiens
ggaaagcuaggaggcuguacag

SEQ ID NO: 2449 - RNA, 20 nt, Homo sapiens
caccaggcauuguggucucc

SEQ ID NO: 2450 - RNA, 20 nt, Homo sapiens
ggagaccacaaugccuggug

SEQ ID NO: 2451 - RNA, 23 nt, Homo sapiens
ugaguaccgccaugucuguuggg

SEQ ID NO: 2452 - RNA, 23 nt, Homo sapiens
cccaacagacauggcgguacuca

SEQ ID NO: 2453 - RNA, 22 nt, Homo sapiens
uacccagagcaugcagugugaa

SEQ ID NO: 2454 - RNA, 22 nt, Homo sapiens
uucacacugcaugcucugggua

SEQ ID NO: 2455 - RNA, 22 nt, Homo sapiens
aagugcugucauagcugagguc

SEQ ID NO: 2456 - RNA, 22 nt, Homo sapiens
gaccucagcuaugacagcacuu

SEQ ID NO: 2457 - RNA, 23 nt, Homo sapiens
cacucagccuugagggcacuuuc

SEQ ID NO: 2458 - RNA, 23 nt, Homo sapiens
gaaagugcccucaaggcugagug

SEQ ID NO: 2459 - RNA, 22 nt, Homo sapiens
ucgacagcacgacacugccuuc

SEQ ID NO: 2460 - RNA, 22 nt, Homo sapiens
gaaggcagugucgugcugucga

SEQ ID NO: 2461 - RNA, 22 nt, Homo sapiens
uagguaguuuccuguuguuggg

SEQ ID NO: 2462 - RNA, 22 nt, Homo sapiens
cccaacaacaggaaacuaccua

SEQ ID NO: 2463 - RNA, 21 nt, Homo sapiens
uacaguacugugauaacugaa

SEQ ID NO: 2464 - RNA, 21 nt, Homo sapiens
uucaguuaucacaguacugua

SEQ ID NO: 2465 - RNA, 22 nt, Homo sapiens
caguuaucacagugcugaugcu

SEQ ID NO: 2466 - RNA, 22 nt, Homo sapiens
agcaucagcacugugauaacug

SEQ ID NO: 2467 - RNA, 23 nt, Homo sapiens
ugugcaaaucuaugcaaaacuga

SEQ ID NO: 2468 - RNA, 23 nt, Homo sapiens
ucaguuuugcauagauuugcaca

SEQ ID NO: 2469 - RNA, 22 nt, Homo sapiens
aguuuugcauaguugcacuaca

SEQ ID NO: 2470 - RNA, 22 nt, Homo sapiens
uguagugcaacuaugcaaaacu

SEQ ID NO: 2471 - RNA, 23 nt, Homo sapiens
aguuuugcagguuugcauccagc

SEQ ID NO: 2472 - RNA, 23 nt, Homo sapiens
gcuggaugcaaaccugcaaaacu

SEQ ID NO: 2473 - RNA, 22 nt, Homo sapiens
aguuuugcagguuugcauuuca

SEQ ID NO: 2474 - RNA, 22 nt, Homo sapiens
ugaaaugcaaaccugcaaaacu

SEQ ID NO: 2475 - RNA, 23 nt, Homo sapiens
ugugcaaauccaugcaaaacuga

SEQ ID NO: 2476 - RNA, 23 nt, Homo sapiens
ucaguuuugcauggauuugcaca

SEQ ID NO: 2477 - RNA, 23 nt, Homo sapiens
uacugcaucaggaacugauugga

SEQ ID NO: 2478 - RNA, 23 nt, Homo sapiens
uccaaucaguuccugaugcagua

SEQ ID NO: 2479 - RNA, 22 nt, Homo sapiens
augguuccgucaagcaccaugg

SEQ ID NO: 2480 - RNA, 22 nt, Homo sapiens
ccauggugcuugacggaaccau

SEQ ID NO: 2481 - RNA, 21 nt, Homo sapiens
agcuacaucuggcuacugggu

SEQ ID NO: 2482 - RNA, 21 nt, Homo sapiens
acccaguagccagauguagcu

SEQ ID NO: 2483 - RNA, 22 nt, Homo sapiens
cucaguagccaguguagauccu

SEQ ID NO: 2484 - RNA, 22 nt, Homo sapiens
aggaucuacacuggcuacugag

SEQ ID NO: 2485 - RNA, 22 nt, Homo sapiens
uuaucagaaucuccagggguac

SEQ ID NO: 2486 - RNA, 22 nt, Homo sapiens
guaccccuggagauucugauaa

SEQ ID NO: 2487 - RNA, 23 nt, Homo sapiens
aucaacagacauuaauugggcgc

SEQ ID NO: 2488 - RNA, 23 nt, Homo sapiens
gcgcccaauuaaugucuguugau

SEQ ID NO: 2489 - RNA, 21 nt, Homo sapiens
caaaacgugaggcgcugcuau

SEQ ID NO: 2490 - RNA, 21 nt, Homo sapiens
auagcagcgccucacguuuug

SEQ ID NO: 2491 - RNA, 22 nt, Homo sapiens
cagcagcaauucauguuuugaa

SEQ ID NO: 2492 - RNA, 22 nt, Homo sapiens
uucaaaacaugaauugcugcug

SEQ ID NO: 2493 - RNA, 18 nt, Homo sapiens
uucacagggaggugucau

SEQ ID NO: 2494 - RNA, 18 nt, Homo sapiens
augacaccucccugugaa

SEQ ID NO: 2495 - RNA, 20 nt, Homo sapiens
gcggagagagaauggggagc

SEQ ID NO: 2496 - RNA, 20 nt, Homo sapiens
gcuccccauucucucuccgc

SEQ ID NO: 2497 - RNA, 21 nt, Homo sapiens
ccugcgagucuccggcggugg

SEQ ID NO: 2498 - RNA, 21 nt, Homo sapiens
ccaccgccggagacucgcagg

SEQ ID NO: 2499 - RNA, 21 nt, Homo sapiens
gggcuagggccugcugccccc

SEQ ID NO: 2500 - RNA, 21 nt, Homo sapiens
gggggcagcaggcccuagccc

SEQ ID NO: 2501 - RNA, 19 nt, Homo sapiens
uucugcugccggccaaggc

SEQ ID NO: 2502 - RNA, 19 nt, Homo sapiens
gccuuggccggcagcagaa

SEQ ID NO: 2503 - RNA, 22 nt, Homo sapiens
uccucaucacacugcaccuuag

SEQ ID NO: 2504 - RNA, 22 nt, Homo sapiens
cuaaggugcagugugaugagga

SEQ ID NO: 2505 - RNA, 20 nt, Homo sapiens
gguagugaguuaucagcuac

SEQ ID NO: 2506 - RNA, 20 nt, Homo sapiens
guagcugauaacucacuacc

SEQ ID NO: 2507 - RNA, 20 nt, Homo sapiens
gauauucagaggcuaggugg

SEQ ID NO: 2508 - RNA, 20 nt, Homo sapiens
ccaccuagccucugaauauc

SEQ ID NO: 2509 - RNA, 21 nt, Homo sapiens
acggcccaggcggcauuggug

SEQ ID NO: 2510 - RNA, 21 nt, Homo sapiens
caccaaugccgccugggccgu

SEQ ID NO: 2511 - RNA, 21 nt, Homo sapiens
agcaugacagaggagaggugg

SEQ ID NO: 2512 - RNA, 21 nt, Homo sapiens
ccaccucuccucugucaugcu

SEQ ID NO: 2513 - RNA, 21 nt, Homo sapiens
gggaagagcuguacggccuuc

SEQ ID NO: 2514 - RNA, 21 nt, Homo sapiens
gaaggccguacagcucuuccc

SEQ ID NO: 2515 - RNA, 19 nt, Homo sapiens
ccgccugagcuagcugugg

SEQ ID NO: 2516 - RNA, 19 nt, Homo sapiens
ccacagcuagcucaggcgg

SEQ ID NO: 2517 - RNA, 24 nt, Homo sapiens
uuggaagcuuggaccaacuagcug

SEQ ID NO: 2518 - RNA, 24 nt, Homo sapiens
cagcuaguugguccaagcuuccaa

SEQ ID NO: 2519 - RNA, 19 nt, Homo sapiens
ucuagugcgggcguucccg

SEQ ID NO: 2520 - RNA, 19 nt, Homo sapiens
cgggaacgcccgcacuaga

SEQ ID NO: 2521 - RNA, 24 nt, Homo sapiens
aggagcagugccggccaaggcgcc

SEQ ID NO: 2522 - RNA, 24 nt, Homo sapiens
ggcgccuuggccggcacugcuccu

SEQ ID NO: 2523 - RNA, 19 nt, Homo sapiens
gaauacgucugguugaucc

SEQ ID NO: 2524 - RNA, 19 nt, Homo sapiens
ggaucaaccagacguauuc

SEQ ID NO: 2525 - RNA, 20 nt, Homo sapiens
cuuauaucagaggcuguggg

SEQ ID NO: 2526 - RNA, 20 nt, Homo sapiens
cccacagccucugauauaag

SEQ ID NO: 2527 - RNA, 20 nt, Homo sapiens
uuccgccagucgguggccgg

SEQ ID NO: 2528 - RNA, 20 nt, Homo sapiens
ccggccaccgacuggcggaa

SEQ ID NO: 2529 - RNA, 19 nt, Homo sapiens
aaggggcugggggagcaca

SEQ ID NO: 2530 - RNA, 19 nt, Homo sapiens
ugugcucccccagccccuu

SEQ ID NO: 2531 - RNA, 23 nt, Homo sapiens
agguugggaucgguugcaaugcu

SEQ ID NO: 2532 - RNA, 23 nt, Homo sapiens
agcauugcaaccgaucccaaccu

SEQ ID NO: 2533 - RNA, 22 nt, Homo sapiens
ggguggggauuuguugcauuac

SEQ ID NO: 2534 - RNA, 22 nt, Homo sapiens
guaaugcaacaaauccccaccc

SEQ ID NO: 2535 - RNA, 22 nt, Homo sapiens
uauugcacuugucccggccugu

SEQ ID NO: 2536 - RNA, 22 nt, Homo sapiens
acaggccgggacaagugcaaua

SEQ ID NO: 2537 - RNA, 22 nt, Homo sapiens
uauugcacucgucccggccucc

SEQ ID NO: 2538 - RNA, 22 nt, Homo sapiens
ggaggccgggacgagugcaaua

SEQ ID NO: 2539 - RNA, 22 nt, Homo sapiens
agggacgggacgcggugcagug

SEQ ID NO: 2540 - RNA, 22 nt, Homo sapiens
cacugcaccgcgucccgucccu

SEQ ID NO: 2541 - RNA, 21 nt, Homo sapiens
aucacauugccagggauuucc

SEQ ID NO: 2542 - RNA, 21 nt, Homo sapiens
ggaaaucccuggcaaugugau

SEQ ID NO: 2543 - RNA, 22 nt, Homo sapiens
gggguuccuggggaugggauuu

SEQ ID NO: 2544 - RNA, 22 nt, Homo sapiens
aaaucccauccccaggaacccc

SEQ ID NO: 2545 - RNA, 22 nt, Homo sapiens
acugcagugaaggcacuuguag

SEQ ID NO: 2546 - RNA, 22 nt, Homo sapiens
cuacaagugccuucacugcagu

SEQ ID NO: 2547 - RNA, 23 nt, Homo sapiens
agcuacauugucugcuggguuuc

SEQ ID NO: 2548 - RNA, 23 nt, Homo sapiens
gaaacccagcagacaauguagcu

SEQ ID NO: 2549 - RNA, 22 nt, Homo sapiens
accuggcauacaauguagauuu

SEQ ID NO: 2550 - RNA, 22 nt, Homo sapiens
aaaucuacauuguaugccaggu

SEQ ID NO: 2551 - RNA, 22 nt, Homo sapiens
ucguaccgugaguaauaaugcg

SEQ ID NO: 2552 - RNA, 22 nt, Homo sapiens
cgcauuauuacucacgguacga

SEQ ID NO: 2553 - RNA, 21 nt, Homo sapiens
cauuauuacuuuugguacgcg

SEQ ID NO: 2554 - RNA, 21 nt, Homo sapiens
cgcguaccaaaaguaauaaug

SEQ ID NO: 2555 - RNA, 23 nt, Homo sapiens
uacuccagagggcgucacucaug

SEQ ID NO: 2556 - RNA, 23 nt, Homo sapiens
caugagugacgcccucuggagua

SEQ ID NO: 2557 - RNA, 21 nt, Homo sapiens
ucccacguuguggcccagcag

SEQ ID NO: 2558 - RNA, 21 nt, Homo sapiens
cugcugggccacaacguggga

SEQ ID NO: 2559 - RNA, 23 nt, Homo sapiens
ccucaccaccccuucugccugca

SEQ ID NO: 2560 - RNA, 23 nt, Homo sapiens
ugcaggcagaagggguggugagg

SEQ ID NO: 2561 - RNA, 24 nt, Homo sapiens
cugcaggcagaaguggggcugaca

SEQ ID NO: 2562 - RNA, 24 nt, Homo sapiens
ugucagccccacuucugccugcag

SEQ ID NO: 2563 - RNA, 21 nt, Homo sapiens
ccaaaccagucgugccugugg

SEQ ID NO: 2564 - RNA, 21 nt, Homo sapiens
ccacaggcacgacugguuugg

SEQ ID NO: 2565 - RNA, 22 nt, Homo sapiens
cucaaaccggcugugccugugg

SEQ ID NO: 2566 - RNA, 22 nt, Homo sapiens
ccacaggcacagccgguuugag

SEQ ID NO: 2567 - RNA, 21 nt, Homo sapiens
acaggcacgacugguuuggca

SEQ ID NO: 2568 - RNA, 21 nt, Homo sapiens
ugccaaaccagucgugccugu

SEQ ID NO: 2569 - RNA, 22 nt, Homo sapiens
uccgaacucuccauuccucugc

SEQ ID NO: 2570 - RNA, 22 nt, Homo sapiens
gcagaggaauggagaguucgga

SEQ ID NO: 2571 - RNA, 20 nt, Homo sapiens
ugggaauggggguaagggcc

SEQ ID NO: 2572 - RNA, 20 nt, Homo sapiens
ggcccuuacccccauuccca

SEQ ID NO: 2573 - RNA, 22 nt, Homo sapiens
aggcgauguggggauguagaga

SEQ ID NO: 2574 - RNA, 22 nt, Homo sapiens
ucucuacauccccacaucgccu

SEQ ID NO: 2575 - RNA, 21 nt, Homo sapiens
uaguggucagagggcuuauga

SEQ ID NO: 2576 - RNA, 21 nt, Homo sapiens
ucauaagcccucugaccacua

SEQ ID NO: 2577 - RNA, 22 nt, Homo sapiens
ucugacaucagugauucuccug

SEQ ID NO: 2578 - RNA, 22 nt, Homo sapiens
caggagaaucacugaugucaga

SEQ ID NO: 2579 - RNA, 22 nt, Homo sapiens
cgcgccugcaggaacugguaga

SEQ ID NO: 2580 - RNA, 22 nt, Homo sapiens
ucuaccaguuccugcaggcgcg

SEQ ID NO: 2581 - RNA, 23 nt, Homo sapiens
ugggcaggggcuuauuguaggag

SEQ ID NO: 2582 - RNA, 23 nt, Homo sapiens
cuccuacaauaagccccugccca

SEQ ID NO: 2583 - RNA, 22 nt, Homo sapiens
ugcaggggucgggugggccagg

SEQ ID NO: 2584 - RNA, 22 nt, Homo sapiens
ccuggcccacccgaccccugca

SEQ ID NO: 2585 - RNA, 20 nt, Homo sapiens
aggcgcacccgaccacaugc

SEQ ID NO: 2586 - RNA, 20 nt, Homo sapiens
gcauguggucgggugcgccu

SEQ ID NO: 2587 - RNA, 22 nt, Homo sapiens
auaguccgaguaacgucggggc

SEQ ID NO: 2588 - RNA, 22 nt, Homo sapiens
gccccgacguuacucggacuau

SEQ ID NO: 2589 - RNA, 23 nt, Homo sapiens
cugggcccgcggcgggcgugggg

SEQ ID NO: 2590 - RNA, 23 nt, Homo sapiens
ccccacgcccgccgcgggcccag

SEQ ID NO: 2591 - RNA, 21 nt, Homo sapiens
uacuuggaaaggcaucaguug

SEQ ID NO: 2592 - RNA, 21 nt, Homo sapiens
caacugaugccuuuccaagua

SEQ ID NO: 2593 - RNA, 22 nt, Homo sapiens
ugcaacgaaccugagccacuga

SEQ ID NO: 2594 - RNA, 22 nt, Homo sapiens
ucaguggcucagguucguugca

SEQ ID NO: 2595 - RNA, 22 nt, Homo sapiens
ugcaacuuaccugagucauuga

SEQ ID NO: 2596 - RNA, 22 nt, Homo sapiens
ucaaugacucagguaaguugca

SEQ ID NO: 2597 - RNA, 21 nt, Homo sapiens
cacuguguccuuucugcguag

SEQ ID NO: 2598 - RNA, 21 nt, Homo sapiens
cuacgcagaaaggacacagug

SEQ ID NO: 2599 - RNA, 22 nt, Homo sapiens
cacuggcuccuuucuggguaga

SEQ ID NO: 2600 - RNA, 22 nt, Homo sapiens
ucuacccagaaaggagccagug

SEQ ID NO: 2601 - RNA, 22 nt, Homo sapiens
cacuguuuccuuucugagugga

SEQ ID NO: 2602 - RNA, 22 nt, Homo sapiens
uccacucagaaaggaaacagug

SEQ ID NO: 2603 - RNA, 21 nt, Homo sapiens
uauucagaaaggugccaguca

SEQ ID NO: 2604 - RNA, 21 nt, Homo sapiens
ugacuggcaccuuucugaaua

SEQ ID NO: 2605 - RNA, 20 nt, Homo sapiens
auuccuagaaauuguucaua

SEQ ID NO: 2606 - RNA, 20 nt, Homo sapiens
uaugaacaauuucuaggaau

SEQ ID NO: 2607 - RNA, 22 nt, Homo sapiens
uaauacugucugguaaaaccgu

SEQ ID NO: 2608 - RNA, 22 nt, Homo sapiens
acgguuuuaccagacaguauua

SEQ ID NO: 2609 - RNA, 22 nt, Homo sapiens
ugaaacauacacgggaaaccuc

SEQ ID NO: 2610 - RNA, 22 nt, Homo sapiens
gagguuucccguguauguuuca

SEQ ID NO: 2611 - RNA, 22 nt, Homo sapiens
cuauacaaccuacugccuuccc

SEQ ID NO: 2612 - RNA, 22 nt, Homo sapiens
gggaaggcaguagguuguauag

SEQ ID NO: 2613 - RNA, 22 nt, Homo sapiens
ugagguaguagguugugugguu

SEQ ID NO: 2614 - RNA, 22 nt, Homo sapiens
aaccacacaaccuacuaccuca

SEQ ID NO: 2615 - RNA, 22 nt, Homo sapiens
uaacacugucugguaacgaugu

SEQ ID NO: 2616 - RNA, 22 nt, Homo sapiens
acaucguuaccagacaguguua

SEQ ID NO: 2617 - RNA, 22 nt, Homo sapiens
caucuuaccggacagugcugga

SEQ ID NO: 2618 - RNA, 22 nt, Homo sapiens
uccagcacuguccgguaagaug

SEQ ID NO: 2619 - RNA, 22 nt, Homo sapiens
uaauacugccugguaaugauga

SEQ ID NO: 2620 - RNA, 22 nt, Homo sapiens
ucaucauuaccaggcaguauua

SEQ ID NO: 2621 - RNA, 22 nt, Homo sapiens
caucuuacugggcagcauugga

SEQ ID NO: 2622 - RNA, 22 nt, Homo sapiens
uccaaugcugcccaguaagaug

SEQ ID NO: 2623 - RNA, 23 nt, Homo sapiens
uaauacugccggguaaugaugga

SEQ ID NO: 2624 - RNA, 23 nt, Homo sapiens
uccaucauuacccggcaguauua

SEQ ID NO: 2625 - RNA, 22 nt, Homo sapiens
cgucuuacccagcaguguuugg

SEQ ID NO: 2626 - RNA, 22 nt, Homo sapiens
ccaaacacugcuggguaagacg

SEQ ID NO: 2627 - RNA, 22 nt, Homo sapiens
uccagcaucagugauuuuguug

SEQ ID NO: 2628 - RNA, 22 nt, Homo sapiens
caacaaaaucacugaugcugga

SEQ ID NO: 2629 - RNA, 20 nt, Homo sapiens
uacaguauagaugauguacu

SEQ ID NO: 2630 - RNA, 20 nt, Homo sapiens
aguacaucaucuauacugua

SEQ ID NO: 2631 - RNA, 22 nt, Homo sapiens
ggauaucaucauauacuguaag

SEQ ID NO: 2632 - RNA, 22 nt, Homo sapiens
cuuacaguauaugaugauaucc

SEQ ID NO: 2633 - RNA, 21 nt, Homo sapiens
cggggcagcucaguacaggau

SEQ ID NO: 2634 - RNA, 21 nt, Homo sapiens
auccuguacugagcugccccg

SEQ ID NO: 2635 - RNA, 21 nt, Homo sapiens
uccuucugcuccgucccccag

SEQ ID NO: 2636 - RNA, 21 nt, Homo sapiens
cugggggacggagcagaagga

SEQ ID NO: 2637 - RNA, 21 nt, Homo sapiens
cgggggcggggccgaagcgcg

SEQ ID NO: 2638 - RNA, 21 nt, Homo sapiens
cgcgcuucggccccgcccccg

SEQ ID NO: 2639 - RNA, 21 nt, Homo sapiens
uccugcgcgucccagaugccc

SEQ ID NO: 2640 - RNA, 21 nt, Homo sapiens
gggcaucugggacgcgcagga

SEQ ID NO: 2641 - RNA, 22 nt, Homo sapiens
caucagaauucauggaggcuag

SEQ ID NO: 2642 - RNA, 22 nt, Homo sapiens
cuagccuccaugaauucugaug

SEQ ID NO: 2643 - RNA, 22 nt, Homo sapiens
agcuuccaugacuccugaugga

SEQ ID NO: 2644 - RNA, 22 nt, Homo sapiens
uccaucaggagucauggaagcu

SEQ ID NO: 2645 - RNA, 21 nt, Homo sapiens
ugacagcgcccugccuggcuc

SEQ ID NO: 2646 - RNA, 21 nt, Homo sapiens
gagccaggcagggcgcuguca

SEQ ID NO: 2647 - RNA, 24 nt, Homo sapiens
agcgcgggcugagcgcugccaguc

SEQ ID NO: 2648 - RNA, 24 nt, Homo sapiens
gacuggcagcgcucagcccgcgcu

SEQ ID NO: 2649 - RNA, 22 nt, Homo sapiens
cugggaggugugauaucguggu

SEQ ID NO: 2650 - RNA, 22 nt, Homo sapiens
accacgauaucacaccucccag

SEQ ID NO: 2651 - RNA, 22 nt, Homo sapiens
ugugauaucaugguuccuggga

SEQ ID NO: 2652 - RNA, 22 nt, Homo sapiens
ucccaggaaccaugauaucaca

SEQ ID NO: 2653 - RNA, 22 nt, Homo sapiens
aggugcuccaggcuggcucaca

SEQ ID NO: 2654 - RNA, 22 nt, Homo sapiens
ugugagccagccuggagcaccu

SEQ ID NO: 2655 - RNA, 22 nt, Homo sapiens
gagcaauguagguagacuguuu

SEQ ID NO: 2656 - RNA, 22 nt, Homo sapiens
aaacagucuaccuacauugcuc

SEQ ID NO: 2657 - RNA, 22 nt, Homo sapiens
uguccucuagggccugcagucu

SEQ ID NO: 2658 - RNA, 22 nt, Homo sapiens
agacugcaggcccuagaggaca

SEQ ID NO: 2659 - RNA, 20 nt, Homo sapiens
aaaggcauaaaaccaagaca

SEQ ID NO: 2660 - RNA, 20 nt, Homo sapiens
ugucuugguuuuaugccuuu

SEQ ID NO: 2661 - RNA, 21 nt, Homo sapiens
uaacgcauaauauggacaugu

SEQ ID NO: 2662 - RNA, 21 nt, Homo sapiens
acauguccauauuaugcguua

SEQ ID NO: 2663 - RNA, 22 nt, Homo sapiens
uugaggaaaagauggucuuauu

SEQ ID NO: 2664 - RNA, 22 nt, Homo sapiens
aauaagaccaucuuuuccucaa

SEQ ID NO: 2665 - RNA, 26 nt, Homo sapiens
aagaggaagaaauggcugguucucag

SEQ ID NO: 2666 - RNA, 26 nt, Homo sapiens
cugagaaccagccauuucuuccucuu

SEQ ID NO: 2667 - RNA, 20 nt, Homo sapiens
gcucggacugagcagguggg

SEQ ID NO: 2668 - RNA, 20 nt, Homo sapiens
cccaccugcucaguccgagc

SEQ ID NO: 2669 - RNA, 21 nt, Homo sapiens
acagggccgcagauggagacu

SEQ ID NO: 2670 - RNA, 21 nt, Homo sapiens
agucuccaucugcggcccugu

SEQ ID NO: 2671 - RNA, 21 nt, Homo sapiens
gcagagaacaaaggacucagu

SEQ ID NO: 2672 - RNA, 21 nt, Homo sapiens
acugaguccuuuguucucugc

SEQ ID NO: 2673 - RNA, 22 nt, Homo sapiens
acugauuaucuuaacucucuga

SEQ ID NO: 2674 - RNA, 22 nt, Homo sapiens
ucagagaguuaagauaaucagu

SEQ ID NO: 2675 - RNA, 23 nt, Homo sapiens
ucucugaguaccauaugccuugu

SEQ ID NO: 2676 - RNA, 23 nt, Homo sapiens
acaaggcauaugguacucagaga

SEQ ID NO: 2677 - RNA, 22 nt, Homo sapiens
aacuaguaauguuggauuaggg

SEQ ID NO: 2678 - RNA, 22 nt, Homo sapiens
cccuaauccaacauuacuaguu

SEQ ID NO: 2679 - RNA, 22 nt, Homo sapiens
auauguauaugugacugcuacu

SEQ ID NO: 2680 - RNA, 22 nt, Homo sapiens
aguagcagucacauauacauau

SEQ ID NO: 2681 - RNA, 21 nt, Homo sapiens
uggccaaaaagcaggcagaga

SEQ ID NO: 2682 - RNA, 21 nt, Homo sapiens
ucucugccugcuuuuuggcca

SEQ ID NO: 2683 - RNA, 22 nt, Homo sapiens
ggaggaaccuuggagcuucggc

SEQ ID NO: 2684 - RNA, 22 nt, Homo sapiens
gccgaagcuccaagguuccucc

SEQ ID NO: 2685 - RNA, 23 nt, Homo sapiens
gaggcugaugugaguagaccacu

SEQ ID NO: 2686 - RNA, 23 nt, Homo sapiens
aguggucuacucacaucagccuc

SEQ ID NO: 2687 - RNA, 21 nt, Homo sapiens
cuguccuaagguuguugaguu

SEQ ID NO: 2688 - RNA, 21 nt, Homo sapiens
aacucaacaaccuuaggacag

SEQ ID NO: 2689 - RNA, 21 nt, Homo sapiens
ucuucaaccucaggacuugca

SEQ ID NO: 2690 - RNA, 21 nt, Homo sapiens
ugcaaguccugagguugaaga

SEQ ID NO: 2691 - RNA, 22 nt, Homo sapiens
ugugauaucaugguuccuggga

SEQ ID NO: 2692 - RNA, 22 nt, Homo sapiens
ucccaggaaccaugauaucaca

SEQ ID NO: 2693 - RNA, 22 nt, Homo sapiens
cugggaggugugauauuguggu

SEQ ID NO: 2694 - RNA, 22 nt, Homo sapiens
accacaauaucacaccucccag

SEQ ID NO: 2695 - RNA, 22 nt, Homo sapiens
cagguagauauuugauaggcau

SEQ ID NO: 2696 - RNA, 22 nt, Homo sapiens
augccuaucaaauaucuaccug

SEQ ID NO: 2697 - RNA, 21 nt, Homo sapiens
gccuaucacauaucugccugu

SEQ ID NO: 2698 - RNA, 21 nt, Homo sapiens
acaggcagauaugugauaggc

SEQ ID NO: 2699 - RNA, 20 nt, Homo sapiens
gggcuggggcgcggggaggu

SEQ ID NO: 2700 - RNA, 20 nt, Homo sapiens
accuccccgcgccccagccc

SEQ ID NO: 2701 - RNA, 18 nt, Homo sapiens
ugcuuccuuucagagggu

SEQ ID NO: 2702 - RNA, 18 nt, Homo sapiens
acccucugaaaggaagca

SEQ ID NO: 2703 - RNA, 21 nt, Homo sapiens
ugaguuggccaucugagugag

SEQ ID NO: 2704 - RNA, 21 nt, Homo sapiens
cucacucagauggccaacuca

SEQ ID NO: 2705 - RNA, 23 nt, Homo sapiens
aacauucauuguugucggugggu

SEQ ID NO: 2706 - RNA, 23 nt, Homo sapiens
acccaccgacaacaaugaauguu

SEQ ID NO: 2707 - RNA, 21 nt, Homo sapiens
ucacagugaaccggucucuuu

SEQ ID NO: 2708 - RNA, 21 nt, Homo sapiens
aaagagaccgguucacuguga

SEQ ID NO: 2709 - RNA, 22 nt, Homo sapiens
caacaaaucacagucugccaua

SEQ ID NO: 2710 - RNA, 22 nt, Homo sapiens
uauggcagacugugauuuguug

SEQ ID NO: 2711 - RNA, 21 nt, Homo sapiens
cucacugaacaaugaaugcaa

SEQ ID NO: 2712 - RNA, 21 nt, Homo sapiens
uugcauucauuguucagugag

SEQ ID NO: 2713 - RNA, 23 nt, Homo sapiens
aacauucauugcugucggugggu

SEQ ID NO: 2714 - RNA, 23 nt, Homo sapiens
acccaccgacagcaaugaauguu

SEQ ID NO: 2715 - RNA, 22 nt, Homo sapiens
accaucgaccguugauuguacc

SEQ ID NO: 2716 - RNA, 22 nt, Homo sapiens
gguacaaucaacggucgauggu

SEQ ID NO: 2717 - RNA, 23 nt, Homo sapiens
aacauucaacgcugucggugagu

SEQ ID NO: 2718 - RNA, 23 nt, Homo sapiens
acucaccgacagcguugaauguu

SEQ ID NO: 2719 - RNA, 22 nt, Homo sapiens
accacugaccguugacuguacc

SEQ ID NO: 2720 - RNA, 22 nt, Homo sapiens
gguacagucaacggucaguggu

SEQ ID NO: 2721 - RNA, 22 nt, Homo sapiens
cuguugccacuaaccucaaccu

SEQ ID NO: 2722 - RNA, 22 nt, Homo sapiens
agguugagguuaguggcaacag

SEQ ID NO: 2723 - RNA, 22 nt, Homo sapiens
auaagacgagcaaaaagcuugu

SEQ ID NO: 2724 - RNA, 22 nt, Homo sapiens
acaagcuuuuugcucgucuuau

SEQ ID NO: 2725 - RNA, 22 nt, Homo sapiens
auaagacgaacaaaagguuugu

SEQ ID NO: 2726 - RNA, 22 nt, Homo sapiens
acaaaccuuuuguucgucuuau

SEQ ID NO: 2727 - RNA, 21 nt, Homo sapiens
agggagggacgggggcugugc

SEQ ID NO: 2728 - RNA, 21 nt, Homo sapiens
gcacagcccccgucccucccu

SEQ ID NO: 2729 - RNA, 23 nt, Homo sapiens
ucuggcuccgugucuucacuccc

SEQ ID NO: 2730 - RNA, 23 nt, Homo sapiens
gggagugaagacacggagccaga

SEQ ID NO: 2731 - RNA, 22 nt, Homo sapiens
uggaauguaaagaaguauguau

SEQ ID NO: 2732 - RNA, 22 nt, Homo sapiens
auacauacuucuuuacauucca

SEQ ID NO: 2733 - RNA, 22 nt, Homo sapiens
aacaucacagcaagucugugcu

SEQ ID NO: 2734 - RNA, 22 nt, Homo sapiens
agcacagacuugcugugauguu

SEQ ID NO: 2735 - RNA, 21 nt, Homo sapiens
uuaagacuugcagugauguuu

SEQ ID NO: 2736 - RNA, 21 nt, Homo sapiens
aaacaucacugcaagucuuaa

SEQ ID NO: 2737 - RNA, 22 nt, Homo sapiens
aacaucacugcaagucuuaaca

SEQ ID NO: 2738 - RNA, 22 nt, Homo sapiens
uguuaagacuugcagugauguu

SEQ ID NO: 2739 - RNA, 21 nt, Homo sapiens
acagacuugcugugauguuca

SEQ ID NO: 2740 - RNA, 21 nt, Homo sapiens
ugaacaucacagcaagucugu

SEQ ID NO: 2741 - RNA, 22 nt, Homo sapiens
aaaccguuaccauuacugaguu

SEQ ID NO: 2742 - RNA, 22 nt, Homo sapiens
aacucaguaaugguaacgguuu

SEQ ID NO: 2743 - RNA, 22 nt, Homo sapiens
uagcaagagaaccauuaccauu

SEQ ID NO: 2744 - RNA, 22 nt, Homo sapiens
aaugguaaugguucucuugcua

SEQ ID NO: 2745 - RNA, 23 nt, Homo sapiens
ugaggggcagagagcgagacuuu

SEQ ID NO: 2746 - RNA, 23 nt, Homo sapiens
aaagucucgcucucugccccuca

SEQ ID NO: 2747 - RNA, 22 nt, Homo sapiens
caagcucgcuucuaugggucug

SEQ ID NO: 2748 - RNA, 22 nt, Homo sapiens
cagacccauagaagcgagcuug

SEQ ID NO: 2749 - RNA, 22 nt, Homo sapiens
aacccguagauccgaucuugug

SEQ ID NO: 2750 - RNA, 22 nt, Homo sapiens
cacaagaucggaucuacggguu

SEQ ID NO: 2751 - RNA, 22 nt, Homo sapiens
caagcucgugucuguggguccg

SEQ ID NO: 2752 - RNA, 22 nt, Homo sapiens
cggacccacagacacgagcuug

SEQ ID NO: 2753 - RNA, 22 nt, Homo sapiens
cacccguagaaccgaccuugcg

SEQ ID NO: 2754 - RNA, 22 nt, Homo sapiens
cgcaaggucgguucuacgggug

SEQ ID NO: 2755 - RNA, 23 nt, Homo sapiens
uggagacgcggcccuguuggagu

SEQ ID NO: 2756 - RNA, 23 nt, Homo sapiens
acuccaacagggccgcgucucca

SEQ ID NO: 2757 - RNA, 23 nt, Homo sapiens
ucuacagugcacgugucuccagu

SEQ ID NO: 2758 - RNA, 23 nt, Homo sapiens
acuggagacacgugcacuguaga

SEQ ID NO: 2759 - RNA, 22 nt, Homo sapiens
caaauucguaucuaggggaaua

SEQ ID NO: 2760 - RNA, 22 nt, Homo sapiens
uauuccccuagauacgaauuug

SEQ ID NO: 2761 - RNA, 23 nt, Homo sapiens
uacccuguagauccgaauuugug

SEQ ID NO: 2762 - RNA, 23 nt, Homo sapiens
cacaaauucggaucuacagggua

SEQ ID NO: 2763 - RNA, 23 nt, Homo sapiens
ccugcagcgacuugauggcuucc

SEQ ID NO: 2764 - RNA, 23 nt, Homo sapiens
ggaagccaucaagucgcugcagg

SEQ ID NO: 2765 - RNA, 22 nt, Homo sapiens
ucagugcacuacagaacuuugu

SEQ ID NO: 2766 - RNA, 22 nt, Homo sapiens
acaaaguucuguagugcacuga

SEQ ID NO: 2767 - RNA, 22 nt, Homo sapiens
aaaguucugagacacuccgacu

SEQ ID NO: 2768 - RNA, 22 nt, Homo sapiens
agucggagugucucagaacuuu

SEQ ID NO: 2769 - RNA, 22 nt, Homo sapiens
ccuguucuccauuacuuggcuc

SEQ ID NO: 2770 - RNA, 22 nt, Homo sapiens
gagccaaguaauggagaacagg

SEQ ID NO: 2771 - RNA, 21 nt, Homo sapiens
uucaaguaauucaggauaggu

SEQ ID NO: 2772 - RNA, 21 nt, Homo sapiens
accuauccugaauuacuugaa

SEQ ID NO: 2773 - RNA, 22 nt, Homo sapiens
gcccugaacgaggggucuggag

SEQ ID NO: 2774 - RNA, 22 nt, Homo sapiens
cuccagaccccucguucagggc

SEQ ID NO: 2775 - RNA, 22 nt, Homo sapiens
gcugacuccuaguccagggcuc

SEQ ID NO: 2776 - RNA, 22 nt, Homo sapiens
gagcccuggacuaggagucagc

SEQ ID NO: 2777 - RNA, 22 nt, Homo sapiens
aucacacaaaggcaacuuuugu

SEQ ID NO: 2778 - RNA, 22 nt, Homo sapiens
acaaaaguugccuuugugugau

SEQ ID NO: 2779 - RNA, 22 nt, Homo sapiens
agagguugcccuuggugaauuc

SEQ ID NO: 2780 - RNA, 22 nt, Homo sapiens
gaauucaccaagggcaaccucu

SEQ ID NO: 2781 - RNA, 21 nt, Homo sapiens
gguagauuuuccuucuauggu

SEQ ID NO: 2782 - RNA, 21 nt, Homo sapiens
accauagaaggaaaaucuacc

SEQ ID NO: 2783 - RNA, 21 nt, Homo sapiens
aucauagaggaaaauccacgu

SEQ ID NO: 2784 - RNA, 21 nt, Homo sapiens
acguggauuuuccucuaugau

SEQ ID NO: 2785 - RNA, 22 nt, Homo sapiens
guagauucuccuucuaugagua

SEQ ID NO: 2786 - RNA, 22 nt, Homo sapiens
uacucauagaaggagaaucuac

SEQ ID NO: 2787 - RNA, 22 nt, Homo sapiens
cugguacaggccugggggacag

SEQ ID NO: 2788 - RNA, 22 nt, Homo sapiens
cugucccccaggccuguaccag

SEQ ID NO: 2789 - RNA, 22 nt, Homo sapiens
ucucccaacccuuguaccagug

SEQ ID NO: 2790 - RNA, 22 nt, Homo sapiens
cacugguacaaggguugggaga

SEQ ID NO: 2791 - RNA, 22 nt, Homo sapiens
acggguuaggcucuugggagcu

SEQ ID NO: 2792 - RNA, 22 nt, Homo sapiens
agcucccaagagccuaacccgu

SEQ ID NO: 2793 - RNA, 22 nt, Homo sapiens
ucacaagucaggcucuugggac

SEQ ID NO: 2794 - RNA, 22 nt, Homo sapiens
gucccaagagccugacuuguga

SEQ ID NO: 2795 - RNA, 22 nt, Homo sapiens
aacccguagauccgaacuugug

SEQ ID NO: 2796 - RNA, 22 nt, Homo sapiens
cacaaguucggaucuacggguu

SEQ ID NO: 2797 - RNA, 21 nt, Homo sapiens
cuguacaggccacugccuugc

SEQ ID NO: 2798 - RNA, 21 nt, Homo sapiens
gcaaggcaguggccuguacag

SEQ ID NO: 2799 - RNA, 22 nt, Homo sapiens
ugagguaguaguuuguacaguu

SEQ ID NO: 2800 - RNA, 22 nt, Homo sapiens
aacuguacaaacuacuaccuca

SEQ ID NO: 2801 - RNA, 22 nt, Homo sapiens
ucccugagacccuaacuuguga

SEQ ID NO: 2802 - RNA, 22 nt, Homo sapiens
ucacaaguuagggucucaggga

SEQ ID NO: 2803 - RNA, 22 nt, Homo sapiens
caagcuuguaucuauagguaug

SEQ ID NO: 2804 - RNA, 22 nt, Homo sapiens
cauaccuauagauacaagcuug

SEQ ID NO: 2805 - RNA, 23 nt, Homo sapiens
aaagugcugcgacauuugagcgu

SEQ ID NO: 2806 - RNA, 23 nt, Homo sapiens
acgcucaaaugucgcagcacuuu

SEQ ID NO: 2807 - RNA, 22 nt, Homo sapiens
uuuagagacggggucuugcucu

SEQ ID NO: 2808 - RNA, 22 nt, Homo sapiens
agagcaagaccccgucucuaaa

SEQ ID NO: 2809 - RNA, 24 nt, Homo sapiens
uggcccugacugaagaccagcagu

SEQ ID NO: 2810 - RNA, 24 nt, Homo sapiens
acugcuggucuucagucagggcca

SEQ ID NO: 2811 - RNA, 21 nt, Homo sapiens
gcgacccauacuugguuucag

SEQ ID NO: 2812 - RNA, 21 nt, Homo sapiens
cugaaaccaaguaugggucgc

SEQ ID NO: 2813 - RNA, 22 nt, Homo sapiens
gaaaucaagcgugggugagacc

SEQ ID NO: 2814 - RNA, 22 nt, Homo sapiens
ggucucacccacgcuugauuuc

SEQ ID NO: 2815 - RNA, 21 nt, Homo sapiens
cccugggccucugcuccccag

SEQ ID NO: 2816 - RNA, 21 nt, Homo sapiens
cuggggagcagaggcccaggg

SEQ ID NO: 2817 - RNA, 24 nt, Homo sapiens
uggggagcugaggcucugggggug

SEQ ID NO: 2818 - RNA, 24 nt, Homo sapiens
cacccccagagccucagcucccca

SEQ ID NO: 2819 - RNA, 20 nt, Homo sapiens
ggggagcuguggaagcagua

SEQ ID NO: 2820 - RNA, 20 nt, Homo sapiens
uacugcuuccacagcucccc

SEQ ID NO: 2821 - RNA, 25 nt, Homo sapiens
cuagugagggacagaaccaggauuc

SEQ ID NO: 2822 - RNA, 25 nt, Homo sapiens
gaauccugguucugucccucacuag

SEQ ID NO: 2823 - RNA, 20 nt, Homo sapiens
agagucuugugaugucuugc

SEQ ID NO: 2824 - RNA, 20 nt, Homo sapiens
gcaagacaucacaagacucu

SEQ ID NO: 2825 - RNA, 23 nt, Homo sapiens
gcagcagagaauaggacuacguc

SEQ ID NO: 2826 - RNA, 23 nt, Homo sapiens
gacguaguccuauucucugcugc

SEQ ID NO: 2827 - RNA, 23 nt, Homo sapiens
ugagcgccucgacgacagagccg

SEQ ID NO: 2828 - RNA, 23 nt, Homo sapiens
cggcucugucgucgaggcgcuca

SEQ ID NO: 2829 - RNA, 23 nt, Homo sapiens
ucccuguccuccaggagcucacg

SEQ ID NO: 2830 - RNA, 23 nt, Homo sapiens
cgugagcuccuggaggacaggga

SEQ ID NO: 2831 - RNA, 22 nt, Homo sapiens
cuauacggccuccuagcuuucc

SEQ ID NO: 2832 - RNA, 22 nt, Homo sapiens
ggaaagcuaggaggccguauag

SEQ ID NO: 2833 - RNA, 22 nt, Homo sapiens
ugagguaggagguuguauaguu

SEQ ID NO: 2834 - RNA, 22 nt, Homo sapiens
aacuauacaaccuccuaccuca

SEQ ID NO: 2835 - RNA, 22 nt, Homo sapiens
cugcgcaagcuacugccuugcu

SEQ ID NO: 2836 - RNA, 22 nt, Homo sapiens
agcaaggcaguagcuugcgcag

SEQ ID NO: 2837 - RNA, 22 nt, Homo sapiens
ugagguaguaguuugugcuguu

SEQ ID NO: 2838 - RNA, 22 nt, Homo sapiens
aacagcacaaacuacuaccuca

SEQ ID NO: 2839 - RNA, 22 nt, Homo sapiens
ugcccuguggacucaguucugg

SEQ ID NO: 2840 - RNA, 22 nt, Homo sapiens
ccagaacugaguccacagggca

SEQ ID NO: 2841 - RNA, 21 nt, Homo sapiens
ugguucuagacuugccaacua

SEQ ID NO: 2842 - RNA, 21 nt, Homo sapiens
uaguuggcaagucuagaacca

SEQ ID NO: 2843 - RNA, 23 nt, Homo sapiens
ugucugcccgcaugccugccucu

SEQ ID NO: 2844 - RNA, 23 nt, Homo sapiens
agaggcaggcaugcgggcagaca

SEQ ID NO: 2845 - RNA, 22 nt, Homo sapiens
aaaaguaauugcggucuuuggu

SEQ ID NO: 2846 - RNA, 22 nt, Homo sapiens
accaaagaccgcaauuacuuuu

SEQ ID NO: 2847 - RNA, 18 nt, Homo sapiens
ucgaggagcucacagucu

SEQ ID NO: 2848 - RNA, 18 nt, Homo sapiens
agacugugagcuccucga

SEQ ID NO: 2849 - RNA, 22 nt, Homo sapiens
cuauacaaucuauugccuuccc

SEQ ID NO: 2850 - RNA, 22 nt, Homo sapiens
gggaaggcaauagauuguauag

SEQ ID NO: 2851 - RNA, 22 nt, Homo sapiens
cuauacagucuacugucuuucc

SEQ ID NO: 2852 - RNA, 22 nt, Homo sapiens
ggaaagacaguagacuguauag

SEQ ID NO: 2853 - RNA, 22 nt, Homo sapiens
ugagguaguagauuguauaguu

SEQ ID NO: 2854 - RNA, 22 nt, Homo sapiens
aacuauacaaucuacuaccuca

SEQ ID NO: 2855 - RNA, 22 nt, Homo sapiens
aaaaguaauugugguuuuggcc

SEQ ID NO: 2856 - RNA, 22 nt, Homo sapiens
ggccaaaaccacaauuacuuuu

SEQ ID NO: 2857 - RNA, 22 nt, Homo sapiens
aaaaguaauugcgguuuuugcc

SEQ ID NO: 2858 - RNA, 22 nt, Homo sapiens
ggcaaaaaccgcaauuacuuuu

SEQ ID NO: 2859 - RNA, 22 nt, Homo sapiens
ccucugaaauucaguucuucag

SEQ ID NO: 2860 - RNA, 22 nt, Homo sapiens
cugaagaacugaauuucagagg

SEQ ID NO: 2861 - RNA, 22 nt, Homo sapiens
ugagaacugaauuccauggguu

SEQ ID NO: 2862 - RNA, 22 nt, Homo sapiens
aacccauggaauucaguucuca

SEQ ID NO: 2863 - RNA, 22 nt, Homo sapiens
acagcaggcacagacaggcagu

SEQ ID NO: 2864 - RNA, 22 nt, Homo sapiens
acugccugucugugccugcugu

SEQ ID NO: 2865 - RNA, 22 nt, Homo sapiens
ugccugucuacacuugcugugc

SEQ ID NO: 2866 - RNA, 22 nt, Homo sapiens
gcacagcaaguguagacaggca

SEQ ID NO: 2867 - RNA, 22 nt, Homo sapiens
uagcaccaucugaaaucgguua

SEQ ID NO: 2868 - RNA, 22 nt, Homo sapiens
uaaccgauuucagauggugcua

SEQ ID NO: 2869 - RNA, 22 nt, Homo sapiens
acugauuucuuuugguguucag

SEQ ID NO: 2870 - RNA, 22 nt, Homo sapiens
cugaacaccaaaagaaaucagu

SEQ ID NO: 2871 - RNA, 24 nt, Homo sapiens
gcugguuucauauggugguuuaga

SEQ ID NO: 2872 - RNA, 24 nt, Homo sapiens
ucuaaaccaccauaugaaaccagc

SEQ ID NO: 2873 - RNA, 22 nt, Homo sapiens
cugguuucacaugguggcuuag

SEQ ID NO: 2874 - RNA, 22 nt, Homo sapiens
cuaagccaccaugugaaaccag

SEQ ID NO: 2875 - RNA, 23 nt, Homo sapiens
uagcaccauuugaaaucaguguu

SEQ ID NO: 2876 - RNA, 23 nt, Homo sapiens
aacacugauuucaaauggugcua

SEQ ID NO: 2877 - RNA, 22 nt, Homo sapiens
uagcaccauuugaaaucgguua

SEQ ID NO: 2878 - RNA, 22 nt, Homo sapiens
uaaccgauuucaaauggugcua

SEQ ID NO: 2879 - RNA, 22 nt, Homo sapiens
ugaccgauuucuccugguguuc

SEQ ID NO: 2880 - RNA, 22 nt, Homo sapiens
gaacaccaggagaaaucgguca

SEQ ID NO: 2881 - RNA, 23 nt, Homo sapiens
ugucacucggcucggcccacuac

SEQ ID NO: 2882 - RNA, 23 nt, Homo sapiens
guagugggccgagccgagugaca

SEQ ID NO: 2883 - RNA, 22 nt, Homo sapiens
cugccaauuccauaggucacag

SEQ ID NO: 2884 - RNA, 22 nt, Homo sapiens
cugugaccuauggaauuggcag

SEQ ID NO: 2885 - RNA, 21 nt, Homo sapiens
cugaccuaugaauugacagcc

SEQ ID NO: 2886 - RNA, 21 nt, Homo sapiens
ggcugucaauucauaggucag

SEQ ID NO: 2887 - RNA, 20 nt, Homo sapiens
acugccccaggugcugcugg

SEQ ID NO: 2888 - RNA, 20 nt, Homo sapiens
ccagcagcaccuggggcagu

SEQ ID NO: 2889 - RNA, 22 nt, Homo sapiens
aacgccauuaucacacuaaaua

SEQ ID NO: 2890 - RNA, 22 nt, Homo sapiens
uauuuagugugauaauggcguu

SEQ ID NO: 2891 - RNA, 22 nt, Homo sapiens
cuuucagucggauguuugcagc

SEQ ID NO: 2892 - RNA, 22 nt, Homo sapiens
gcugcaaacauccgacugaaag

SEQ ID NO: 2893 - RNA, 22 nt, Homo sapiens
aauugcacgguauccaucugua

SEQ ID NO: 2894 - RNA, 22 nt, Homo sapiens
uacagauggauaccgugcaauu

SEQ ID NO: 2895 - RNA, 22 nt, Homo sapiens
cggguggaucacgaugcaauuu

SEQ ID NO: 2896 - RNA, 22 nt, Homo sapiens
aaauugcaucgugauccacccg

SEQ ID NO: 2897 - RNA, 22 nt, Homo sapiens
cugggagguggauguuuacuuc

SEQ ID NO: 2898 - RNA, 22 nt, Homo sapiens
gaaguaaacauccaccucccag

SEQ ID NO: 2899 - RNA, 22 nt, Homo sapiens
uguaaacauccuacacucagcu

SEQ ID NO: 2900 - RNA, 22 nt, Homo sapiens
agcugaguguaggauguuuaca

SEQ ID NO: 2901 - RNA, 22 nt, Homo sapiens
cugggagaggguuguuuacucc

SEQ ID NO: 2902 - RNA, 22 nt, Homo sapiens
ggaguaaacaacccucucccag

SEQ ID NO: 2903 - RNA, 22 nt, Homo sapiens
cugggagaaggcuguuuacucu

SEQ ID NO: 2904 - RNA, 22 nt, Homo sapiens
agaguaaacagccuucucccag

SEQ ID NO: 2905 - RNA, 23 nt, Homo sapiens
uguaaacauccuacacucucagc

SEQ ID NO: 2906 - RNA, 23 nt, Homo sapiens
gcugagaguguaggauguuuaca

SEQ ID NO: 2907 - RNA, 22 nt, Homo sapiens
uuuuucauuauugcuccugacc

SEQ ID NO: 2908 - RNA, 22 nt, Homo sapiens
ggucaggagcaauaaugaaaaa

SEQ ID NO: 2909 - RNA, 23 nt, Homo sapiens
ucaagagcaauaacgaaaaaugu

SEQ ID NO: 2910 - RNA, 23 nt, Homo sapiens
acauuuuucguuauugcucuuga

SEQ ID NO: 2911 - RNA, 23 nt, Homo sapiens
caaagugcuuacagugcagguag

SEQ ID NO: 2912 - RNA, 23 nt, Homo sapiens
cuaccugcacuguaagcacuuug

SEQ ID NO: 2913 - RNA, 22 nt, Homo sapiens
ggauuccuggaaauacuguucu

SEQ ID NO: 2914 - RNA, 22 nt, Homo sapiens
agaacaguauuuccaggaaucc

SEQ ID NO: 2915 - RNA, 23 nt, Homo sapiens
guccaguuuucccaggaaucccu

SEQ ID NO: 2916 - RNA, 23 nt, Homo sapiens
agggauuccugggaaaacuggac

SEQ ID NO: 2917 - RNA, 22 nt, Homo sapiens
acugcauuaugagcacuuaaag

SEQ ID NO: 2918 - RNA, 22 nt, Homo sapiens
cuuuaagugcucauaaugcagu

SEQ ID NO: 2919 - RNA, 23 nt, Homo sapiens
uaaagugcuuauagugcagguag

SEQ ID NO: 2920 - RNA, 23 nt, Homo sapiens
cuaccugcacuauaagcacuuua

SEQ ID NO: 2921 - RNA, 22 nt, Homo sapiens
gaggguuggguggaggcucucc

SEQ ID NO: 2922 - RNA, 22 nt, Homo sapiens
ggagagccuccacccaacccuc

SEQ ID NO: 2923 - RNA, 22 nt, Homo sapiens
cugugcgugugacagcggcuga

SEQ ID NO: 2924 - RNA, 22 nt, Homo sapiens
ucagccgcugucacacgcacag

SEQ ID NO: 2925 - RNA, 22 nt, Homo sapiens
ccaguggggcugcuguuaucug

SEQ ID NO: 2926 - RNA, 22 nt, Homo sapiens
cagauaacagcagccccacugg

SEQ ID NO: 2927 - RNA, 22 nt, Homo sapiens
uguaacagcaacuccaugugga

SEQ ID NO: 2928 - RNA, 22 nt, Homo sapiens
uccacauggaguugcuguuaca

SEQ ID NO: 2929 - RNA, 22 nt, Homo sapiens
ucacaguggucucugggauuau

SEQ ID NO: 2930 - RNA, 22 nt, Homo sapiens
auaaucccagagaccacuguga

SEQ ID NO: 2931 - RNA, 22 nt, Homo sapiens
uaaucucagcuggcaacuguga

SEQ ID NO: 2932 - RNA, 22 nt, Homo sapiens
ucacaguugccagcugagauua

SEQ ID NO: 2933 - RNA, 22 nt, Homo sapiens
cagugccucggcagugcagccc

SEQ ID NO: 2934 - RNA, 22 nt, Homo sapiens
gggcugcacugccgaggcacug

SEQ ID NO: 2935 - RNA, 20 nt, Homo sapiens
gugcauugcuguugcauugc

SEQ ID NO: 2936 - RNA, 20 nt, Homo sapiens
gcaaugcaacagcaaugcac

SEQ ID NO: 2937 - RNA, 19 nt, Homo sapiens
acuggacuuggaggcagaa

SEQ ID NO: 2938 - RNA, 19 nt, Homo sapiens
uucugccuccaaguccagu

SEQ ID NO: 2939 - RNA, 25 nt, Homo sapiens
acuggacuuggagucagaagagugg

SEQ ID NO: 2940 - RNA, 25 nt, Homo sapiens
ccacucuucugacuccaaguccagu

SEQ ID NO: 2941 - RNA, 20 nt, Homo sapiens
acuggacuuggagucagaaa

SEQ ID NO: 2942 - RNA, 20 nt, Homo sapiens
uuucugacuccaaguccagu

SEQ ID NO: 2943 - RNA, 19 nt, Homo sapiens
acuggacuuggagucagga

SEQ ID NO: 2944 - RNA, 19 nt, Homo sapiens
uccugacuccaaguccagu

SEQ ID NO: 2945 - RNA, 20 nt, Homo sapiens
acuggacuuggagccagaag

SEQ ID NO: 2946 - RNA, 20 nt, Homo sapiens
cuucuggcuccaaguccagu

SEQ ID NO: 2947 - RNA, 20 nt, Homo sapiens
acugggcuuggagucagaag

SEQ ID NO: 2948 - RNA, 20 nt, Homo sapiens
cuucugacuccaagcccagu

SEQ ID NO: 2949 - RNA, 21 nt, Homo sapiens
acuggacuuggugucagaugg

SEQ ID NO: 2950 - RNA, 21 nt, Homo sapiens
ccaucugacaccaaguccagu

SEQ ID NO: 2951 - RNA, 21 nt, Homo sapiens
acuggacuaggagucagaagg

SEQ ID NO: 2952 - RNA, 21 nt, Homo sapiens
ccuucugacuccuaguccagu

SEQ ID NO: 2953 - RNA, 19 nt, Homo sapiens
acuggauuuggagccagaa

SEQ ID NO: 2954 - RNA, 19 nt, Homo sapiens
uucuggcuccaaauccagu

SEQ ID NO: 2955 - RNA, 20 nt, Homo sapiens
aggaauguuccuucuuugcc

SEQ ID NO: 2956 - RNA, 20 nt, Homo sapiens
ggcaaagaaggaacauuccu

SEQ ID NO: 2957 - RNA, 21 nt, Homo sapiens
ucagugcaugacagaacuugg

SEQ ID NO: 2958 - RNA, 21 nt, Homo sapiens
ccaaguucugucaugcacuga

SEQ ID NO: 2959 - RNA, 20 nt, Homo sapiens
ucacaccugccucgcccccc

SEQ ID NO: 2960 - RNA, 20 nt, Homo sapiens
ggggggcgaggcagguguga

SEQ ID NO: 2961 - RNA, 21 nt, Homo sapiens
gugggcgggggcaggugugug

SEQ ID NO: 2962 - RNA, 21 nt, Homo sapiens
cacacaccugcccccgcccac

SEQ ID NO: 2963 - RNA, 22 nt, Homo sapiens
acgcccuucccccccuucuuca

SEQ ID NO: 2964 - RNA, 22 nt, Homo sapiens
ugaagaagggggggaagggcgu

SEQ ID NO: 2965 - RNA, 22 nt, Homo sapiens
uugcauauguaggaugucccau

SEQ ID NO: 2966 - RNA, 22 nt, Homo sapiens
augggacauccuacauaugcaa

SEQ ID NO: 2967 - RNA, 23 nt, Homo sapiens
guuugcacgggugggccuugucu

SEQ ID NO: 2968 - RNA, 23 nt, Homo sapiens
agacaaggcccacccgugcaaac

SEQ ID NO: 2969 - RNA, 22 nt, Homo sapiens
gacuauagaacuuucccccuca

SEQ ID NO: 2970 - RNA, 22 nt, Homo sapiens
ugagggggaaaguucuauaguc

SEQ ID NO: 2971 - RNA, 21 nt, Homo sapiens
agggggaaaguucuauagucc

SEQ ID NO: 2972 - RNA, 21 nt, Homo sapiens
ggacuauagaacuuucccccu

SEQ ID NO: 2973 - RNA, 21 nt, Homo sapiens
cuuuuugcggucugggcuugc

SEQ ID NO: 2974 - RNA, 21 nt, Homo sapiens
gcaagcccagaccgcaaaaag

SEQ ID NO: 2975 - RNA, 21 nt, Homo sapiens
ucuuguguucucuagaucagu

SEQ ID NO: 2976 - RNA, 21 nt, Homo sapiens
acugaucuagagaacacaaga

SEQ ID NO: 2977 - RNA, 23 nt, Homo sapiens
cccaguguucagacuaccuguuc

SEQ ID NO: 2978 - RNA, 23 nt, Homo sapiens
gaacagguagucugaacacuggg

SEQ ID NO: 2979 - RNA, 22 nt, Homo sapiens
acaguagucugcacauugguua

SEQ ID NO: 2980 - RNA, 22 nt, Homo sapiens
uaaccaaugugcagacuacugu

SEQ ID NO: 2981 - RNA, 22 nt, Homo sapiens
acaguagucugcacauugguua

SEQ ID NO: 2982 - RNA, 22 nt, Homo sapiens
uaaccaaugugcagacuacugu

SEQ ID NO: 2983 - RNA, 23 nt, Homo sapiens
cccaguguuuagacuaucuguuc

SEQ ID NO: 2984 - RNA, 23 nt, Homo sapiens
gaacagauagucuaaacacuggg

SEQ ID NO: 2985 - RNA, 22 nt, Homo sapiens
uggagugugacaaugguguuug

SEQ ID NO: 2986 - RNA, 22 nt, Homo sapiens
caaacaccauugucacacucca

SEQ ID NO: 2987 - RNA, 22 nt, Homo sapiens
ugcccuaaaugccccuucuggc

SEQ ID NO: 2988 - RNA, 22 nt, Homo sapiens
gccagaaggggcauuuagggca

SEQ ID NO: 2989 - RNA, 23 nt, Homo sapiens
uaaggugcaucuagugcaguuag

SEQ ID NO: 2990 - RNA, 23 nt, Homo sapiens
cuaacugcacuagaugcaccuua

SEQ ID NO: 2991 - RNA, 22 nt, Homo sapiens
cuccuauaugaugccuuucuuc

SEQ ID NO: 2992 - RNA, 22 nt, Homo sapiens
gaagaaaggcaucauauaggag

SEQ ID NO: 2993 - RNA, 21 nt, Homo sapiens
gaacggcuucauacaggaguu

SEQ ID NO: 2994 - RNA, 21 nt, Homo sapiens
aacuccuguaugaagccguuc

SEQ ID NO: 2995 - RNA, 22 nt, Homo sapiens
ugugacugguugaccagagggg

SEQ ID NO: 2996 - RNA, 22 nt, Homo sapiens
ccccucuggucaaccagucaca

SEQ ID NO: 2997 - RNA, 23 nt, Homo sapiens
acugcccuaagugcuccuucugg

SEQ ID NO: 2998 - RNA, 23 nt, Homo sapiens
ccagaaggagcacuuagggcagu

SEQ ID NO: 2999 - RNA, 23 nt, Homo sapiens
uaaggugcaucuagugcagauag

SEQ ID NO: 3000 - RNA, 23 nt, Homo sapiens
cuaucugcacuagaugcaccuua

SEQ ID NO: 3001 - RNA, 22 nt, Homo sapiens
cagugcaaugaugaaagggcau

SEQ ID NO: 3002 - RNA, 22 nt, Homo sapiens
augcccuuucaucauugcacug

SEQ ID NO: 3003 - RNA, 21 nt, Homo sapiens
acucuuucccuguugcacuac

SEQ ID NO: 3004 - RNA, 21 nt, Homo sapiens
guagugcaacagggaaagagu

SEQ ID NO: 3005 - RNA, 24 nt, Homo sapiens
uuuggcaaugguagaacucacacu

SEQ ID NO: 3006 - RNA, 24 nt, Homo sapiens
agugugaguucuaccauugccaaa

SEQ ID NO: 3007 - RNA, 21 nt, Homo sapiens
agggcccccccucaauccugu

SEQ ID NO: 3008 - RNA, 21 nt, Homo sapiens
acaggauugagggggggcccu

SEQ ID NO: 3009 - RNA, 22 nt, Homo sapiens
cagugcaauguuaaaagggcau

SEQ ID NO: 3010 - RNA, 22 nt, Homo sapiens
augcccuuuuaacauugcacug

SEQ ID NO: 3011 - RNA, 22 nt, Homo sapiens
uucacauugugcuacugucugc

SEQ ID NO: 3012 - RNA, 22 nt, Homo sapiens
gcagacaguagcacaaugugaa

SEQ ID NO: 3013 - RNA, 22 nt, Homo sapiens
ucggauccgucugagcuuggcu

SEQ ID NO: 3014 - RNA, 22 nt, Homo sapiens
agccaagcucagacggauccga

SEQ ID NO: 3015 - RNA, 22 nt, Homo sapiens
cugaagcucagagggcucugau

SEQ ID NO: 3016 - RNA, 22 nt, Homo sapiens
aucagagcccucugagcuucag

SEQ ID NO: 3017 - RNA, 22 nt, Homo sapiens
ccucuuccccuugucucuccag

SEQ ID NO: 3018 - RNA, 22 nt, Homo sapiens
cuggagagacaaggggaagagg

SEQ ID NO: 3019 - RNA, 22 nt, Homo sapiens
ugagugacaggggaaaugggga

SEQ ID NO: 3020 - RNA, 22 nt, Homo sapiens
uccccauuuccccugucacuca

SEQ ID NO: 3021 - RNA, 22 nt, Homo sapiens
ucaggacacuucugaacuugga

SEQ ID NO: 3022 - RNA, 22 nt, Homo sapiens
uccaaguucagaaguguccuga

SEQ ID NO: 3023 - RNA, 22 nt, Homo sapiens
caguucagaaguguuccugagu

SEQ ID NO: 3024 - RNA, 22 nt, Homo sapiens
acucaggaacacuucugaacug

SEQ ID NO: 3025 - RNA, 21 nt, Homo sapiens
uuucccuuuccauccuggcag

SEQ ID NO: 3026 - RNA, 21 nt, Homo sapiens
cugccaggauggaaagggaaa

SEQ ID NO: 3027 - RNA, 21 nt, Homo sapiens
uugccagggcaggagguggaa

SEQ ID NO: 3028 - RNA, 21 nt, Homo sapiens
uuccaccuccugcccuggcaa

SEQ ID NO: 3029 - RNA, 21 nt, Homo sapiens
agagauugguagaaaucaggu

SEQ ID NO: 3030 - RNA, 21 nt, Homo sapiens
accugauuucuaccaaucucu

SEQ ID NO: 3031 - RNA, 23 nt, Homo sapiens
aaucggacccauuuaaaccggag

SEQ ID NO: 3032 - RNA, 23 nt, Homo sapiens
cuccgguuuaaauggguccgauu

SEQ ID NO: 3033 - RNA, 24 nt, Homo sapiens
ucugggcacaggcggauggacagg

SEQ ID NO: 3034 - RNA, 24 nt, Homo sapiens
ccuguccauccgccugugcccaga

SEQ ID NO: 3035 - RNA, 21 nt, Homo sapiens
ccagugacugagcuggagcca

SEQ ID NO: 3036 - RNA, 21 nt, Homo sapiens
uggcuccagcucagucacugg

SEQ ID NO: 3037 - RNA, 22 nt, Homo sapiens
aggauaggaagaaugaagugcu

SEQ ID NO: 3038 - RNA, 22 nt, Homo sapiens
agcacuucauucuuccuauccu

SEQ ID NO: 3039 - RNA, 22 nt, Homo sapiens
aggagaguggauuccagguggu

SEQ ID NO: 3040 - RNA, 22 nt, Homo sapiens
accaccuggaauccacucuccu

SEQ ID NO: 3041 - RNA, 22 nt, Homo sapiens
uccuccucuaccucaucccagu

SEQ ID NO: 3042 - RNA, 22 nt, Homo sapiens
acugggaugagguagaggagga

SEQ ID NO: 3043 - RNA, 22 nt, Homo sapiens
ugagggguuuggaaugggaugg

SEQ ID NO: 3044 - RNA, 22 nt, Homo sapiens
ccaucccauuccaaaccccuca

SEQ ID NO: 3045 - RNA, 21 nt, Homo sapiens
auccaguucucugagggggcu

SEQ ID NO: 3046 - RNA, 21 nt, Homo sapiens
agcccccucagagaacuggau

SEQ ID NO: 3047 - RNA, 22 nt, Homo sapiens
aaccccuaaggcaacuggaugg

SEQ ID NO: 3048 - RNA, 22 nt, Homo sapiens
ccauccaguugccuuagggguu

SEQ ID NO: 3049 - RNA, 21 nt, Homo sapiens
ucauccucgucucccucccag

SEQ ID NO: 3050 - RNA, 21 nt, Homo sapiens
cugggagggagacgaggauga

SEQ ID NO: 3051 - RNA, 22 nt, Homo sapiens
agggaaggggacgaggguuggg

SEQ ID NO: 3052 - RNA, 22 nt, Homo sapiens
cccaacccucguccccuucccu

SEQ ID NO: 3053 - RNA, 23 nt, Homo sapiens
aagaagagacugagucaucgaau

SEQ ID NO: 3054 - RNA, 23 nt, Homo sapiens
auucgaugacucagucucuucuu

SEQ ID NO: 3055 - RNA, 23 nt, Homo sapiens
caauggcacaaacucauucuuga

SEQ ID NO: 3056 - RNA, 23 nt, Homo sapiens
ucaagaaugaguuugugccauug

SEQ ID NO: 3057 - RNA, 21 nt, Homo sapiens
acugaauccucuuuuccucag

SEQ ID NO: 3058 - RNA, 21 nt, Homo sapiens
cugaggaaaagaggauucagu

SEQ ID NO: 3059 - RNA, 22 nt, Homo sapiens
ugggaugagggauugaagugga

SEQ ID NO: 3060 - RNA, 22 nt, Homo sapiens
uccacuucaaucccucauccca

SEQ ID NO: 3061 - RNA, 22 nt, Homo sapiens
caggccauauugugcugccuca

SEQ ID NO: 3062 - RNA, 22 nt, Homo sapiens
ugaggcagcacaauauggccug

SEQ ID NO: 3063 - RNA, 22 nt, Homo sapiens
uagcagcacauaaugguuugug

SEQ ID NO: 3064 - RNA, 22 nt, Homo sapiens
cacaaaccauuaugugcugcua

SEQ ID NO: 3065 - RNA, 22 nt, Homo sapiens
cgaaucauuauuugcugcucua

SEQ ID NO: 3066 - RNA, 22 nt, Homo sapiens
uagagcagcaaauaaugauucg

SEQ ID NO: 3067 - RNA, 22 nt, Homo sapiens
uagcagcacaucaugguuuaca

SEQ ID NO: 3068 - RNA, 22 nt, Homo sapiens
uguaaaccaugaugugcugcua

SEQ ID NO: 3069 - RNA, 22 nt, Homo sapiens
ccaauauuacugugcugcuuua

SEQ ID NO: 3070 - RNA, 22 nt, Homo sapiens
uaaagcagcacaguaauauugg

SEQ ID NO: 3071 - RNA, 22 nt, Homo sapiens
cuagguauggucccagggaucc

SEQ ID NO: 3072 - RNA, 22 nt, Homo sapiens
ggaucccugggaccauaccuag

SEQ ID NO: 3073 - RNA, 20 nt, Homo sapiens
guguguggaaaugcuucugc

SEQ ID NO: 3074 - RNA, 20 nt, Homo sapiens
gcagaagcauuuccacacac

SEQ ID NO: 3075 - RNA, 22 nt, Homo sapiens
gugugcggaaaugcuucugcua

SEQ ID NO: 3076 - RNA, 22 nt, Homo sapiens
uagcagaagcauuuccgcacac

SEQ ID NO: 3077 - RNA, 23 nt, Homo sapiens
agcagcauuguacagggcuauca

SEQ ID NO: 3078 - RNA, 23 nt, Homo sapiens
ugauagcccuguacaaugcugcu

SEQ ID NO: 3079 - RNA, 22 nt, Homo sapiens
aacuggcccucaaagucccgcu

SEQ ID NO: 3080 - RNA, 22 nt, Homo sapiens
agcgggacuuugagggccaguu

SEQ ID NO: 3081 - RNA, 22 nt, Homo sapiens
cgggguuuugagggcgagauga

SEQ ID NO: 3082 - RNA, 22 nt, Homo sapiens
ucaucucgcccucaaaaccccg

SEQ ID NO: 3083 - RNA, 21 nt, Homo sapiens
gcagggacagcaaaggggugc

SEQ ID NO: 3084 - RNA, 21 nt, Homo sapiens
gcaccccuuugcugucccugc

SEQ ID NO: 3085 - RNA, 22 nt, Homo sapiens
uucccuuugucauccuucgccu

SEQ ID NO: 3086 - RNA, 22 nt, Homo sapiens
aggcgaaggaugacaaagggaa

SEQ ID NO: 3087 - RNA, 23 nt, Homo sapiens
auggccaaaacugcaguuauuuu

SEQ ID NO: 3088 - RNA, 23 nt, Homo sapiens
aaaauaacugcaguuuuggccau

SEQ ID NO: 3089 - RNA, 25 nt, Homo sapiens
aaaaaccacaauuacuuuugcacca

SEQ ID NO: 3090 - RNA, 25 nt, Homo sapiens
uggugcaaaaguaauugugguuuuu

SEQ ID NO: 3091 - RNA, 21 nt, Homo sapiens
caaaagugaucgugguuuuug

SEQ ID NO: 3092 - RNA, 21 nt, Homo sapiens
caaaaaccacgaucacuuuug

SEQ ID NO: 3093 - RNA, 23 nt, Homo sapiens
caaagacugcaauuacuuuugcg

SEQ ID NO: 3094 - RNA, 23 nt, Homo sapiens
cgcaaaaguaauugcagucuuug

SEQ ID NO: 3095 - RNA, 23 nt, Homo sapiens
aaaaguaacugcgguuuuugccu

SEQ ID NO: 3096 - RNA, 23 nt, Homo sapiens
aggcaaaaaccgcaguuacuuuu

SEQ ID NO: 3097 - RNA, 22 nt, Homo sapiens
ugccuggaacauaguagggacu

SEQ ID NO: 3098 - RNA, 22 nt, Homo sapiens
agucccuacuauguuccaggca

SEQ ID NO: 3099 - RNA, 21 nt, Homo sapiens
auaggacucauauagugccag

SEQ ID NO: 3100 - RNA, 21 nt, Homo sapiens
cuggcacuauaugaguccuau

SEQ ID NO: 3101 - RNA, 20 nt, Homo sapiens
agacacuauacgagucauau

SEQ ID NO: 3102 - RNA, 20 nt, Homo sapiens
auaugacucguauagugucu

SEQ ID NO: 3103 - RNA, 23 nt, Homo sapiens
ugugacugcauuaugaaaauucu

SEQ ID NO: 3104 - RNA, 23 nt, Homo sapiens
agaauuuucauaaugcagucaca

SEQ ID NO: 3105 - RNA, 20 nt, Homo sapiens
uggcuuuuaacuuugauggc

SEQ ID NO: 3106 - RNA, 20 nt, Homo sapiens
gccaucaaaguuaaaagcca

SEQ ID NO: 3107 - RNA, 21 nt, Homo sapiens
cacagcaaguguagacaggca

SEQ ID NO: 3108 - RNA, 21 nt, Homo sapiens
ugccugucuacacuugcugug

SEQ ID NO: 3109 - RNA, 21 nt, Homo sapiens
ccugucugugccugcuguaca

SEQ ID NO: 3110 - RNA, 21 nt, Homo sapiens
uguacagcaggcacagacagg

SEQ ID NO: 3111 - RNA, 22 nt, Homo sapiens
uaaauagaguaggcaaaggaca

SEQ ID NO: 3112 - RNA, 22 nt, Homo sapiens
uguccuuugccuacucuauuua

SEQ ID NO: 3113 - RNA, 22 nt, Homo sapiens
uccuuugccuauucuauuuaag

SEQ ID NO: 3114 - RNA, 22 nt, Homo sapiens
cuuaaauagaauaggcaaagga

SEQ ID NO: 3115 - RNA, 22 nt, Homo sapiens
guugggacaagaggacggucuu

SEQ ID NO: 3116 - RNA, 22 nt, Homo sapiens
aagaccguccucuugucccaac

SEQ ID NO: 3117 - RNA, 17 nt, Homo sapiens
cagagaauuguuuaauc

SEQ ID NO: 3118 - RNA, 17 nt, Homo sapiens
gauuaaacaauucucug

SEQ ID NO: 3119 - RNA, 20 nt, Homo sapiens
uagaggaagcuguggagaga

SEQ ID NO: 3120 - RNA, 20 nt, Homo sapiens
ucucuccacagcuuccucua

SEQ ID NO: 3121 - RNA, 22 nt, Homo sapiens
uccccuucugcaggccugcugg

SEQ ID NO: 3122 - RNA, 22 nt, Homo sapiens
ccagcaggccugcagaagggga

SEQ ID NO: 3123 - RNA, 23 nt, Homo sapiens
aucagggcuuguggaaugggaag

SEQ ID NO: 3124 - RNA, 23 nt, Homo sapiens
cuucccauuccacaagcccugau

SEQ ID NO: 3125 - RNA, 23 nt, Homo sapiens
ucuggcaaguaaaaaacucucau

SEQ ID NO: 3126 - RNA, 23 nt, Homo sapiens
augagaguuuuuuacuugccaga

SEQ ID NO: 3127 - RNA, 23 nt, Homo sapiens
ucgaggacugguggaagggccuu

SEQ ID NO: 3128 - RNA, 23 nt, Homo sapiens
aaggcccuuccaccaguccucga

SEQ ID NO: 3129 - RNA, 24 nt, Homo sapiens
uggguagagaaggagcucagagga

SEQ ID NO: 3130 - RNA, 24 nt, Homo sapiens
uccucugagcuccuucucuaccca

SEQ ID NO: 3131 - RNA, 22 nt, Homo sapiens
uaaagaacucuuaaaacccaau

SEQ ID NO: 3132 - RNA, 22 nt, Homo sapiens
auuggguuuuaagaguucuuua

SEQ ID NO: 3133 - RNA, 23 nt, Homo sapiens
ugauggauaaaagacuacauauu

SEQ ID NO: 3134 - RNA, 23 nt, Homo sapiens
aauauguagucuuuuauccauca

SEQ ID NO: 3135 - RNA, 22 nt, Homo sapiens
ugccuaggcugagacugcagug

SEQ ID NO: 3136 - RNA, 22 nt, Homo sapiens
cacugcagucucagccuaggca

SEQ ID NO: 3137 - RNA, 22 nt, Homo sapiens
uggcccaaccuauucaguuagu

SEQ ID NO: 3138 - RNA, 22 nt, Homo sapiens
acuaacugaauagguugggcca

SEQ ID NO: 3139 - RNA, 23 nt, Homo sapiens
cugacugaauagguagggucauu

SEQ ID NO: 3140 - RNA, 23 nt, Homo sapiens
aaugacccuaccuauucagucag

SEQ ID NO: 3141 - RNA, 24 nt, Homo sapiens
ucuguagccugggagcaauggggu

SEQ ID NO: 3142 - RNA, 24 nt, Homo sapiens
accccauugcucccaggcuacaga

SEQ ID NO: 3143 - RNA, 23 nt, Homo sapiens
uaggagcucaacagaugccuguu

SEQ ID NO: 3144 - RNA, 23 nt, Homo sapiens
aacaggcaucuguugagcuccua

SEQ ID NO: 3145 - RNA, 19 nt, Homo sapiens
gagggcggguggaggagga

SEQ ID NO: 3146 - RNA, 19 nt, Homo sapiens
uccuccuccacccgcccuc

SEQ ID NO: 3147 - RNA, 25 nt, Homo sapiens
auaacauuguaaagcgcuucuuucg

SEQ ID NO: 3148 - RNA, 25 nt, Homo sapiens
cgaaagaagcgcuuuacaauguuau

SEQ ID NO: 3149 - RNA, 24 nt, Homo sapiens
agauauuuugaguguuuggaauug

SEQ ID NO: 3150 - RNA, 24 nt, Homo sapiens
caauuccaaacacucaaaauaucu

SEQ ID NO: 3151 - RNA, 22 nt, Homo sapiens
aacuccaaacacucaaaacuca

SEQ ID NO: 3152 - RNA, 22 nt, Homo sapiens
ugaguuuugaguguuuggaguu

SEQ ID NO: 3153 - RNA, 22 nt, Homo sapiens
caugcuaggauagaaagaaugg

SEQ ID NO: 3154 - RNA, 22 nt, Homo sapiens
ccauucuuucuauccuagcaug

SEQ ID NO: 3155 - RNA, 24 nt, Homo sapiens
gguugggcagugaggaggguguga

SEQ ID NO: 3156 - RNA, 24 nt, Homo sapiens
ucacacccuccucacugcccaacc

SEQ ID NO: 3157 - RNA, 22 nt, Homo sapiens
uggaaaaaacuggugugugcuu

SEQ ID NO: 3158 - RNA, 22 nt, Homo sapiens
aagcacacaccaguuuuuucca

SEQ ID NO: 3159 - RNA, 22 nt, Homo sapiens
cuggggagauccucgagguugg

SEQ ID NO: 3160 - RNA, 22 nt, Homo sapiens
ccaaccucgaggaucuccccag

SEQ ID NO: 3161 - RNA, 22 nt, Homo sapiens
caaccucgacgaucuccucagc

SEQ ID NO: 3162 - RNA, 22 nt, Homo sapiens
gcugaggagaucgucgagguug

SEQ ID NO: 3163 - RNA, 21 nt, Homo sapiens
ugaggagaucgucgagguugg

SEQ ID NO: 3164 - RNA, 21 nt, Homo sapiens
ccaaccucgacgaucuccuca

SEQ ID NO: 3165 - RNA, 22 nt, Homo sapiens
caaccucgaggaucuccccagc

SEQ ID NO: 3166 - RNA, 22 nt, Homo sapiens
gcuggggagauccucgagguug

SEQ ID NO: 3167 - RNA, 21 nt, Homo sapiens
gguggggcaaugggaucaggu

SEQ ID NO: 3168 - RNA, 21 nt, Homo sapiens
accugaucccauugccccacc

SEQ ID NO: 3169 - RNA, 23 nt, Homo sapiens
ggggaaagcgaguagggacauuu

SEQ ID NO: 3170 - RNA, 23 nt, Homo sapiens
aaaugucccuacucgcuuucccc

SEQ ID NO: 3171 - RNA, 22 nt, Homo sapiens
cagaaggggaguugggagcaga

SEQ ID NO: 3172 - RNA, 22 nt, Homo sapiens
ucugcucccaacuccccuucug

SEQ ID NO: 3173 - RNA, 21 nt, Homo sapiens
ccaggcucugcagugggaacu

SEQ ID NO: 3174 - RNA, 21 nt, Homo sapiens
aguucccacugcagagccugg

SEQ ID NO: 3175 - RNA, 21 nt, Homo sapiens
cucccacuuccagaucuuucu

SEQ ID NO: 3176 - RNA, 21 nt, Homo sapiens
agaaagaucuggaagugggag

SEQ ID NO: 3177 - RNA, 22 nt, Homo sapiens
aaagaucuggaagugggagaca

SEQ ID NO: 3178 - RNA, 22 nt, Homo sapiens
ugucucccacuuccagaucuuu

SEQ ID NO: 3179 - RNA, 22 nt, Homo sapiens
cugcccuagucuagcugaagcu

SEQ ID NO: 3180 - RNA, 22 nt, Homo sapiens
agcuucagcuagacuagggcag

SEQ ID NO: 3181 - RNA, 22 nt, Homo sapiens
uucagccaggcuagugcagucu

SEQ ID NO: 3182 - RNA, 22 nt, Homo sapiens
agacugcacuagccuggcugaa

SEQ ID NO: 3183 - RNA, 22 nt, Homo sapiens
uaggauuacaagugucggccac

SEQ ID NO: 3184 - RNA, 22 nt, Homo sapiens
guggccgacacuuguaauccua

SEQ ID NO: 3185 - RNA, 22 nt, Homo sapiens
agagcugagacuagaaagccca

SEQ ID NO: 3186 - RNA, 22 nt, Homo sapiens
ugggcuuucuagucucagcucu

SEQ ID NO: 3187 - RNA, 22 nt, Homo sapiens
ggcuuucuagucucagcucucc

SEQ ID NO: 3188 - RNA, 22 nt, Homo sapiens
ggagagcugagacuagaaagcc

SEQ ID NO: 3189 - RNA, 23 nt, Homo sapiens
cugauaagaacagaggcccagau

SEQ ID NO: 3190 - RNA, 23 nt, Homo sapiens
aucugggccucuguucuuaucag

SEQ ID NO: 3191 - RNA, 21 nt, Homo sapiens
ucccuaccccuccacucccca

SEQ ID NO: 3192 - RNA, 21 nt, Homo sapiens
uggggaguggagggguaggga

SEQ ID NO: 3193 - RNA, 23 nt, Homo sapiens
uuagggaguagaaggguggggag

SEQ ID NO: 3194 - RNA, 23 nt, Homo sapiens
cuccccacccuucuacucccuaa

SEQ ID NO: 3195 - RNA, 22 nt, Homo sapiens
uauaaaaugagggcaguaagac

SEQ ID NO: 3196 - RNA, 22 nt, Homo sapiens
gucuuacugcccucauuuuaua

SEQ ID NO: 3197 - RNA, 22 nt, Homo sapiens
ugugacuuuaagggaaauggcg

SEQ ID NO: 3198 - RNA, 22 nt, Homo sapiens
cgccauuucccuuaaagucaca

SEQ ID NO: 3199 - RNA, 22 nt, Homo sapiens
agguggaugcaaugugaccuca

SEQ ID NO: 3200 - RNA, 22 nt, Homo sapiens
ugaggucacauugcauccaccu

SEQ ID NO: 3201 - RNA, 23 nt, Homo sapiens
cgcagacaaugccuacuggccua

SEQ ID NO: 3202 - RNA, 23 nt, Homo sapiens
uaggccaguaggcauugucugcg

SEQ ID NO: 3203 - RNA, 17 nt, Homo sapiens
gaguucuacagucagac

SEQ ID NO: 3204 - RNA, 17 nt, Homo sapiens
gucugacuguagaacuc

SEQ ID NO: 3205 - RNA, 22 nt, Homo sapiens
uaggacugugcuuggcacauag

SEQ ID NO: 3206 - RNA, 22 nt, Homo sapiens
cuaugugccaagcacaguccua

SEQ ID NO: 3207 - RNA, 22 nt, Homo sapiens
cugggguucugagacagacagu

SEQ ID NO: 3208 - RNA, 22 nt, Homo sapiens
acugucugucucagaaccccag

SEQ ID NO: 3209 - RNA, 22 nt, Homo sapiens
aaaggaggaaauaggcaggcca

SEQ ID NO: 3210 - RNA, 22 nt, Homo sapiens
uggccugccuauuuccuccuuu

SEQ ID NO: 3211 - RNA, 22 nt, Homo sapiens
ugcccugccuguuuucuccuuu

SEQ ID NO: 3212 - RNA, 22 nt, Homo sapiens
aaaggagaaaacaggcagggca

SEQ ID NO: 3213 - RNA, 23 nt, Homo sapiens
uagugaguuagagaugcagagcc

SEQ ID NO: 3214 - RNA, 23 nt, Homo sapiens
ggcucugcaucucuaacucacua

SEQ ID NO: 3215 - RNA, 19 nt, Homo sapiens
acuggccugggacuaccgg

SEQ ID NO: 3216 - RNA, 19 nt, Homo sapiens
ccgguagucccaggccagu

SEQ ID NO: 3217 - RNA, 21 nt, Homo sapiens
ugcacggcacuggggacacgu

SEQ ID NO: 3218 - RNA, 21 nt, Homo sapiens
acguguccccagugccgugca

SEQ ID NO: 3219 - RNA, 23 nt, Homo sapiens
uguguacacacgugccaggcgcu

SEQ ID NO: 3220 - RNA, 23 nt, Homo sapiens
agcgccuggcacguguguacaca

SEQ ID NO: 3221 - RNA, 17 nt, Homo sapiens
ggggcgcggccggaucg

SEQ ID NO: 3222 - RNA, 17 nt, Homo sapiens
cgauccggccgcgcccc

SEQ ID NO: 3223 - RNA, 22 nt, Homo sapiens
agaaggggugaaauuuaaacgu

SEQ ID NO: 3224 - RNA, 22 nt, Homo sapiens
acguuuaaauuucaccccuucu

SEQ ID NO: 3225 - RNA, 19 nt, Homo sapiens
aucgggcccucggcgccgg

SEQ ID NO: 3226 - RNA, 19 nt, Homo sapiens
ccggcgccgagggcccgau

SEQ ID NO: 3227 - RNA, 17 nt, Homo sapiens
gcuucuguaguguaguc

SEQ ID NO: 3228 - RNA, 17 nt, Homo sapiens
gacuacacuacagaagc

SEQ ID NO: 3229 - RNA, 22 nt, Homo sapiens
gccucucucggagucgcucgga

SEQ ID NO: 3230 - RNA, 22 nt, Homo sapiens
uccgagcgacuccgagagaggc

SEQ ID NO: 3231 - RNA, 23 nt, Homo sapiens
aaagucucgcucucugccccuca

SEQ ID NO: 3232 - RNA, 23 nt, Homo sapiens
ugaggggcagagagcgagacuuu

SEQ ID NO: 3233 - RNA, 24 nt, Homo sapiens
ugaggggccucagaccgagcuuuu

SEQ ID NO: 3234 - RNA, 24 nt, Homo sapiens
aaaagcucggucugaggccccuca

SEQ ID NO: 3235 - RNA, 23 nt, Homo sapiens
agaagaaggcggucggucugcgg

SEQ ID NO: 3236 - RNA, 23 nt, Homo sapiens
ccgcagaccgaccgccuucuucu

SEQ ID NO: 3237 - RNA, 20 nt, Homo sapiens
uuggccauggggcugcgcgg

SEQ ID NO: 3238 - RNA, 20 nt, Homo sapiens
ccgcgcagccccauggccaa

SEQ ID NO: 3239 - RNA, 23 nt, Homo sapiens
ccugggcagcguguggcugaagg

SEQ ID NO: 3240 - RNA, 23 nt, Homo sapiens
ccuucagccacacgcugcccagg

SEQ ID NO: 3241 - RNA, 23 nt, Homo sapiens
agaggcuuugugcggauacgggg

SEQ ID NO: 3242 - RNA, 23 nt, Homo sapiens
ccccguauccgcacaaagccucu

SEQ ID NO: 3243 - RNA, 21 nt, Homo sapiens
cccuugggucugaugggguag

SEQ ID NO: 3244 - RNA, 21 nt, Homo sapiens
cuaccccaucagacccaaggg

SEQ ID NO: 3245 - RNA, 25 nt, Homo sapiens
ugccccaucugugcccuggguagga

SEQ ID NO: 3246 - RNA, 25 nt, Homo sapiens
uccuacccagggcacagauggggca

SEQ ID NO: 3247 - RNA, 23 nt, Homo sapiens
uguggaagguagacggccagaga

SEQ ID NO: 3248 - RNA, 23 nt, Homo sapiens
ucucuggccgucuaccuuccaca

SEQ ID NO: 3249 - RNA, 20 nt, Homo sapiens
ucuggccagcuacgucccca

SEQ ID NO: 3250 - RNA, 20 nt, Homo sapiens
uggggacguagcuggccaga

SEQ ID NO: 3251 - RNA, 23 nt, Homo sapiens
uggggacguagcuggccagacag

SEQ ID NO: 3252 - RNA, 23 nt, Homo sapiens
cugucuggccagcuacgucccca

SEQ ID NO: 3253 - RNA, 22 nt, Homo sapiens
cucucuggccgucuaccuucca

SEQ ID NO: 3254 - RNA, 22 nt, Homo sapiens
uggaagguagacggccagagag

SEQ ID NO: 3255 - RNA, 23 nt, Homo sapiens
ucugggagguuguagcaguggaa

SEQ ID NO: 3256 - RNA, 23 nt, Homo sapiens
uuccacugcuacaaccucccaga

SEQ ID NO: 3257 - RNA, 22 nt, Homo sapiens
uccugcguaggaucugaggagu

SEQ ID NO: 3258 - RNA, 22 nt, Homo sapiens
acuccucagauccuacgcagga

SEQ ID NO: 3259 - RNA, 22 nt, Homo sapiens
agcucugcugcucacuggcagu

SEQ ID NO: 3260 - RNA, 22 nt, Homo sapiens
acugccagugagcagcagagcu

SEQ ID NO: 3261 - RNA, 21 nt, Homo sapiens
ggccagccaccaggagggcug

SEQ ID NO: 3262 - RNA, 21 nt, Homo sapiens
cagcccuccugguggcuggcc

SEQ ID NO: 3263 - RNA, 17 nt, Homo sapiens
cgcgccgggcccggguu

SEQ ID NO: 3264 - RNA, 17 nt, Homo sapiens
aacccgggcccggcgcg

SEQ ID NO: 3265 - RNA, 23 nt, Homo sapiens
ggaggcgcaggcucggaaaggcg

SEQ ID NO: 3266 - RNA, 23 nt, Homo sapiens
cgccuuuccgagccugcgccucc

SEQ ID NO: 3267 - RNA, 22 nt, Homo sapiens
guggaguccuggggaauggaga

SEQ ID NO: 3268 - RNA, 22 nt, Homo sapiens
ucuccauuccccaggacuccac

SEQ ID NO: 3269 - RNA, 23 nt, Homo sapiens
agggacugccuuaggagaaaguu

SEQ ID NO: 3270 - RNA, 23 nt, Homo sapiens
aacuuucuccuaaggcagucccu

SEQ ID NO: 3271 - RNA, 17 nt, Homo sapiens
gggauaugaagaaaaau

SEQ ID NO: 3272 - RNA, 17 nt, Homo sapiens
auuuuucuucauauccc

SEQ ID NO: 3273 - RNA, 22 nt, Homo sapiens
uggaagggagaagagcuuuaau

SEQ ID NO: 3274 - RNA, 22 nt, Homo sapiens
auuaaagcucuucucccuucca

SEQ ID NO: 3275 - RNA, 22 nt, Homo sapiens
acuuuccucacucccgugaagu

SEQ ID NO: 3276 - RNA, 22 nt, Homo sapiens
acuucacgggagugaggaaagu

SEQ ID NO: 3277 - RNA, 21 nt, Homo sapiens
uucgcgggcgaaggcaaaguc

SEQ ID NO: 3278 - RNA, 21 nt, Homo sapiens
gacuuugccuucgcccgcgaa

SEQ ID NO: 3279 - RNA, 22 nt, Homo sapiens
caucuggcauccgucacacaga

SEQ ID NO: 3280 - RNA, 22 nt, Homo sapiens
ucugugugacggaugccagaug

SEQ ID NO: 3281 - RNA, 22 nt, Homo sapiens
ugagggacagaugccagaagca

SEQ ID NO: 3282 - RNA, 22 nt, Homo sapiens
ugcuucuggcaucugucccuca

SEQ ID NO: 3283 - RNA, 22 nt, Homo sapiens
aaacuaaucucuacacugcugc

SEQ ID NO: 3284 - RNA, 22 nt, Homo sapiens
gcagcaguguagagauuaguuu

SEQ ID NO: 3285 - RNA, 22 nt, Homo sapiens
gcaguaguguagagauugguuu

SEQ ID NO: 3286 - RNA, 22 nt, Homo sapiens
aaaccaaucucuacacuacugc

SEQ ID NO: 3287 - RNA, 21 nt, Homo sapiens
gcugcaccggagacuggguaa

SEQ ID NO: 3288 - RNA, 21 nt, Homo sapiens
uuacccagucuccggugcagc

SEQ ID NO: 3289 - RNA, 21 nt, Homo sapiens
uacccagucuccggugcagcc

SEQ ID NO: 3290 - RNA, 21 nt, Homo sapiens
ggcugcaccggagacugggua

SEQ ID NO: 3291 - RNA, 24 nt, Homo sapiens
uguggacagugagguagagggagu

SEQ ID NO: 3292 - RNA, 24 nt, Homo sapiens
acucccucuaccucacuguccaca

SEQ ID NO: 3293 - RNA, 22 nt, Homo sapiens
agcuuuugggaauucagguagu

SEQ ID NO: 3294 - RNA, 22 nt, Homo sapiens
acuaccugaauucccaaaagcu

SEQ ID NO: 3295 - RNA, 21 nt, Homo sapiens
accugaauuaccaaaagcuuu

SEQ ID NO: 3296 - RNA, 21 nt, Homo sapiens
aaagcuuuugguaauucaggu

SEQ ID NO: 3297 - RNA, 22 nt, Homo sapiens
auauaccuguucggucucuuua

SEQ ID NO: 3298 - RNA, 22 nt, Homo sapiens
uaaagagaccgaacagguauau

SEQ ID NO: 3299 - RNA, 22 nt, Homo sapiens
aggggaccaaagagauauauag

SEQ ID NO: 3300 - RNA, 22 nt, Homo sapiens
cuauauaucucuuugguccccu

SEQ ID NO: 3301 - RNA, 23 nt, Homo sapiens
uuuguauggauauguguguguau

SEQ ID NO: 3302 - RNA, 23 nt, Homo sapiens
auacacacacauauccauacaaa

SEQ ID NO: 3303 - RNA, 22 nt, Homo sapiens
uguguuagaauaggggcaauaa

SEQ ID NO: 3304 - RNA, 22 nt, Homo sapiens
uuauugccccuauucuaacaca

SEQ ID NO: 3305 - RNA, 22 nt, Homo sapiens
auugccucuguucuaacacaag

SEQ ID NO: 3306 - RNA, 22 nt, Homo sapiens
cuuguguuagaacagaggcaau

SEQ ID NO: 3307 - RNA, 22 nt, Homo sapiens
aagggcuuccucucugcaggac

SEQ ID NO: 3308 - RNA, 22 nt, Homo sapiens
guccugcagagaggaagcccuu

SEQ ID NO: 3309 - RNA, 21 nt, Homo sapiens
ccugcagagaggaagcccuuc

SEQ ID NO: 3310 - RNA, 21 nt, Homo sapiens
gaagggcuuccucucugcagg

SEQ ID NO: 3311 - RNA, 22 nt, Homo sapiens
aggauuucagaaauacuggugu

SEQ ID NO: 3312 - RNA, 22 nt, Homo sapiens
acaccaguauuucugaaauccu

SEQ ID NO: 3313 - RNA, 24 nt, Homo sapiens
agauguauggaaucuguauauauc

SEQ ID NO: 3314 - RNA, 24 nt, Homo sapiens
gauauauacagauuccauacaucu

SEQ ID NO: 3315 - RNA, 22 nt, Homo sapiens
cggggagagaacgcagugacgu

SEQ ID NO: 3316 - RNA, 22 nt, Homo sapiens
acgucacugcguucucuccccg

SEQ ID NO: 3317 - RNA, 19 nt, Homo sapiens
uggggcggagcuuccggag

SEQ ID NO: 3318 - RNA, 19 nt, Homo sapiens
cuccggaagcuccgcccca

SEQ ID NO: 3319 - RNA, 21 nt, Homo sapiens
ucacgcggagagauggcuuug

SEQ ID NO: 3320 - RNA, 21 nt, Homo sapiens
caaagccaucucuccgcguga

SEQ ID NO: 3321 - RNA, 22 nt, Homo sapiens
caggcgucugucuacguggcuu

SEQ ID NO: 3322 - RNA, 22 nt, Homo sapiens
aagccacguagacagacgccug

SEQ ID NO: 3323 - RNA, 22 nt, Homo sapiens
caccuugcgcuacucaggucug

SEQ ID NO: 3324 - RNA, 22 nt, Homo sapiens
cagaccugaguagcgcaaggug

SEQ ID NO: 3325 - RNA, 22 nt, Homo sapiens
aaucugagaaggcgcacaaggu

SEQ ID NO: 3326 - RNA, 22 nt, Homo sapiens
accuugugcgccuucucagauu

SEQ ID NO: 3327 - RNA, 22 nt, Homo sapiens
aaggccuuucugaaccuucaga

SEQ ID NO: 3328 - RNA, 22 nt, Homo sapiens
ucugaagguucagaaaggccuu

SEQ ID NO: 3329 - RNA, 22 nt, Homo sapiens
gugacaucacauauacggcagc

SEQ ID NO: 3330 - RNA, 22 nt, Homo sapiens
gcugccguauaugugaugucac

SEQ ID NO: 3331 - RNA, 24 nt, Homo sapiens
ucagaacaaaugccgguucccaga

SEQ ID NO: 3332 - RNA, 24 nt, Homo sapiens
ucugggaaccggcauuuguucuga

SEQ ID NO: 3333 - RNA, 22 nt, Homo sapiens
ugagaaccacgucugcucugag

SEQ ID NO: 3334 - RNA, 22 nt, Homo sapiens
cucagagcagacgugguucuca

SEQ ID NO: 3335 - RNA, 17 nt, Homo sapiens
ucauauugcuucuuucu

SEQ ID NO: 3336 - RNA, 17 nt, Homo sapiens
agaaagaagcaauauga

SEQ ID NO: 3337 - RNA, 22 nt, Homo sapiens
ugugacagauugauaacugaaa

SEQ ID NO: 3338 - RNA, 22 nt, Homo sapiens
uuucaguuaucaaucugucaca

SEQ ID NO: 3339 - RNA, 23 nt, Homo sapiens
uggaguccaggaaucugcauuuu

SEQ ID NO: 3340 - RNA, 23 nt, Homo sapiens
aaaaugcagauuccuggacucca

SEQ ID NO: 3341 - RNA, 22 nt, Homo sapiens
aagcccuuaccccaaaaaguau

SEQ ID NO: 3342 - RNA, 22 nt, Homo sapiens
auacuuuuugggguaagggcuu

SEQ ID NO: 3343 - RNA, 22 nt, Homo sapiens
aagcccuuaccccaaaaagcau

SEQ ID NO: 3344 - RNA, 22 nt, Homo sapiens
augcuuuuugggguaagggcuu

SEQ ID NO: 3345 - RNA, 22 nt, Homo sapiens
uggaauguaaggaagugugugg

SEQ ID NO: 3346 - RNA, 22 nt, Homo sapiens
ccacacacuuccuuacauucca

SEQ ID NO: 3347 - RNA, 22 nt, Homo sapiens
cuuaucagauuguauuguaauu

SEQ ID NO: 3348 - RNA, 22 nt, Homo sapiens
aauuacaauacaaucugauaag

SEQ ID NO: 3349 - RNA, 22 nt, Homo sapiens
uuauaauacaaccugauaagug

SEQ ID NO: 3350 - RNA, 22 nt, Homo sapiens
cacuuaucagguuguauuauaa

SEQ ID NO: 3351 - RNA, 22 nt, Homo sapiens
cuuagcagguuguauuaucauu

SEQ ID NO: 3352 - RNA, 22 nt, Homo sapiens
aaugauaauacaaccugcuaag

SEQ ID NO: 3353 - RNA, 22 nt, Homo sapiens
auauaauacaaccugcuaagug

SEQ ID NO: 3354 - RNA, 22 nt, Homo sapiens
cacuuagcagguuguauuauau

SEQ ID NO: 3355 - RNA, 22 nt, Homo sapiens
cacuuagcagguuguauuauau

SEQ ID NO: 3356 - RNA, 22 nt, Homo sapiens
auauaauacaaccugcuaagug

SEQ ID NO: 3357 - RNA, 22 nt, Homo sapiens
auaauacaaccugcuaagugcu

SEQ ID NO: 3358 - RNA, 22 nt, Homo sapiens
agcacuuagcagguuguauuau

SEQ ID NO: 3359 - RNA, 22 nt, Homo sapiens
uuugguccccuucaaccagcug

SEQ ID NO: 3360 - RNA, 22 nt, Homo sapiens
cagcugguugaaggggaccaaa

SEQ ID NO: 3361 - RNA, 22 nt, Homo sapiens
uuugguccccuucaaccagcua

SEQ ID NO: 3362 - RNA, 22 nt, Homo sapiens
uagcugguugaaggggaccaaa

SEQ ID NO: 3363 - RNA, 22 nt, Homo sapiens
uguaaacauccuugacuggaag

SEQ ID NO: 3364 - RNA, 22 nt, Homo sapiens
cuuccagucaaggauguuuaca

SEQ ID NO: 3365 - RNA, 22 nt, Homo sapiens
ugucaguuugucaaauacccca

SEQ ID NO: 3366 - RNA, 22 nt, Homo sapiens
ugggguauuugacaaacugaca

SEQ ID NO: 3367 - RNA, 22 nt, Homo sapiens
cguguauuugacaagcugaguu

SEQ ID NO: 3368 - RNA, 22 nt, Homo sapiens
aacucagcuugucaaauacacg

SEQ ID NO: 3369 - RNA, 21 nt, Homo sapiens
uucacaguggcuaaguuccgc

SEQ ID NO: 3370 - RNA, 21 nt, Homo sapiens
gcggaacuuagccacugugaa

SEQ ID NO: 3371 - RNA, 22 nt, Homo sapiens
agggcuuagcugcuugugagca

SEQ ID NO: 3372 - RNA, 22 nt, Homo sapiens
ugcucacaagcagcuaagcccu

SEQ ID NO: 3373 - RNA, 21 nt, Homo sapiens
aucacauugccagggauuacc

SEQ ID NO: 3374 - RNA, 21 nt, Homo sapiens
gguaaucccuggcaaugugau

SEQ ID NO: 3375 - RNA, 22 nt, Homo sapiens
uggguuccuggcaugcugauuu

SEQ ID NO: 3376 - RNA, 22 nt, Homo sapiens
aaaucagcaugccaggaaccca

SEQ ID NO: 3377 - RNA, 22 nt, Homo sapiens
cuuucagucggauguuuacagc

SEQ ID NO: 3378 - RNA, 22 nt, Homo sapiens
gcuguaaacauccgacugaaag

SEQ ID NO: 3379 - RNA, 22 nt, Homo sapiens
ugccuacugagcugauaucagu

SEQ ID NO: 3380 - RNA, 22 nt, Homo sapiens
acugauaucagcucaguaggca

SEQ ID NO: 3381 - RNA, 22 nt, Homo sapiens
ugccuacugagcugaaacacag

SEQ ID NO: 3382 - RNA, 22 nt, Homo sapiens
cuguguuucagcucaguaggca

SEQ ID NO: 3383 - RNA, 22 nt, Homo sapiens
uggcucaguucagcaggaacag

SEQ ID NO: 3384 - RNA, 22 nt, Homo sapiens
cuguuccugcugaacugagcca

SEQ ID NO: 3385 - RNA, 21 nt, Homo sapiens
uucacaguggcuaaguucugc

SEQ ID NO: 3386 - RNA, 21 nt, Homo sapiens
gcagaacuuagccacugugaa

SEQ ID NO: 3387 - RNA, 22 nt, Homo sapiens
agagcuuagcugauuggugaac

SEQ ID NO: 3388 - RNA, 22 nt, Homo sapiens
guucaccaaucagcuaagcucu

SEQ ID NO: 3389 - RNA, 23 nt, Homo sapiens
uguaguguuuccuacuuuaugga

SEQ ID NO: 3390 - RNA, 23 nt, Homo sapiens
uccauaaaguaggaaacacuaca

SEQ ID NO: 3391 - RNA, 21 nt, Homo sapiens
cauaaaguagaaagcacuacu

SEQ ID NO: 3392 - RNA, 21 nt, Homo sapiens
aguagugcuuucuacuuuaug

SEQ ID NO: 3393 - RNA, 22 nt, Homo sapiens
ugaaggucuacugugugccagg

SEQ ID NO: 3394 - RNA, 22 nt, Homo sapiens
ccuggcacacaguagaccuuca

SEQ ID NO: 3395 - RNA, 22 nt, Homo sapiens
uuguacaugguaggcuuucauu

SEQ ID NO: 3396 - RNA, 22 nt, Homo sapiens
aaugaaagccuaccauguacaa

SEQ ID NO: 3397 - RNA, 21 nt, Homo sapiens
cuggauggcuccuccaugucu

SEQ ID NO: 3398 - RNA, 21 nt, Homo sapiens
agacauggaggagccauccag

SEQ ID NO: 3399 - RNA, 23 nt, Homo sapiens
ucuuggaguaggucauugggugg

SEQ ID NO: 3400 - RNA, 23 nt, Homo sapiens
ccacccaaugaccuacuccaaga

SEQ ID NO: 3401 - RNA, 22 nt, Homo sapiens
cucaucugcaaagaaguaagug

SEQ ID NO: 3402 - RNA, 22 nt, Homo sapiens
cacuuacuucuuugcagaugag

SEQ ID NO: 3403 - RNA, 22 nt, Homo sapiens
aacuguuugcagaggaaacuga

SEQ ID NO: 3404 - RNA, 22 nt, Homo sapiens
ucaguuuccucugcaaacaguu

SEQ ID NO: 3405 - RNA, 22 nt, Homo sapiens
cuugguucagggagggucccca

SEQ ID NO: 3406 - RNA, 22 nt, Homo sapiens
uggggacccucccugaaccaag

SEQ ID NO: 3407 - RNA, 22 nt, Homo sapiens
aggaccuucccugaaccaagga

SEQ ID NO: 3408 - RNA, 22 nt, Homo sapiens
uccuugguucagggaagguccu

SEQ ID NO: 3409 - RNA, 21 nt, Homo sapiens
accuccugugugcauggauua

SEQ ID NO: 3410 - RNA, 21 nt, Homo sapiens
uaauccaugcacacaggaggu

SEQ ID NO: 3411 - RNA, 22 nt, Homo sapiens
uacccauugcauaucggaguug

SEQ ID NO: 3412 - RNA, 22 nt, Homo sapiens
caacuccgauaugcaaugggua

SEQ ID NO: 3413 - RNA, 18 nt, Homo sapiens
aaagcuggguugagaagg

SEQ ID NO: 3414 - RNA, 18 nt, Homo sapiens
ccuucucaacccagcuuu

SEQ ID NO: 3415 - RNA, 20 nt, Homo sapiens
gguauccguuuggggauggu

SEQ ID NO: 3416 - RNA, 20 nt, Homo sapiens
accauccccaaacggauacc

SEQ ID NO: 3417 - RNA, 22 nt, Homo sapiens
gaaggcagcagugcuccccugu

SEQ ID NO: 3418 - RNA, 22 nt, Homo sapiens
acaggggagcacugcugccuuc

SEQ ID NO: 3419 - RNA, 22 nt, Homo sapiens
ucagugcaucacagaacuuugu

SEQ ID NO: 3420 - RNA, 22 nt, Homo sapiens
acaaaguucugugaugcacuga

SEQ ID NO: 3421 - RNA, 22 nt, Homo sapiens
aaguucuguuauacacucaggc

SEQ ID NO: 3422 - RNA, 22 nt, Homo sapiens
gccugaguguauaacagaacuu

SEQ ID NO: 3423 - RNA, 22 nt, Homo sapiens
cuggcccucucugcccuuccgu

SEQ ID NO: 3424 - RNA, 22 nt, Homo sapiens
acggaagggcagagagggccag

SEQ ID NO: 3425 - RNA, 21 nt, Homo sapiens
cuagacugaagcuccuugagg

SEQ ID NO: 3426 - RNA, 21 nt, Homo sapiens
ccucaaggagcuucagucuag

SEQ ID NO: 3427 - RNA, 21 nt, Homo sapiens
ucgaggagcucacagucuagu

SEQ ID NO: 3428 - RNA, 21 nt, Homo sapiens
acuagacugugagcuccucga

SEQ ID NO: 3429 - RNA, 21 nt, Homo sapiens
cacauuacacggucgaccucu

SEQ ID NO: 3430 - RNA, 21 nt, Homo sapiens
agaggucgaccguguaaugug

SEQ ID NO: 3431 - RNA, 22 nt, Homo sapiens
aggugguccguggcgcguucgc

SEQ ID NO: 3432 - RNA, 22 nt, Homo sapiens
gcgaacgcgccacggaccaccu

SEQ ID NO: 3433 - RNA, 23 nt, Homo sapiens
cgcauccccuagggcauuggugu

SEQ ID NO: 3434 - RNA, 23 nt, Homo sapiens
acaccaaugcccuaggggaugcg

SEQ ID NO: 3435 - RNA, 20 nt, Homo sapiens
ccucugggcccuuccuccag

SEQ ID NO: 3436 - RNA, 20 nt, Homo sapiens
cuggaggaagggcccagagg

SEQ ID NO: 3437 - RNA, 23 nt, Homo sapiens
ccuaguagguguccaguaagugu

SEQ ID NO: 3438 - RNA, 23 nt, Homo sapiens
acacuuacuggacaccuacuagg

SEQ ID NO: 3439 - RNA, 21 nt, Homo sapiens
acggugcuggauguggccuuu

SEQ ID NO: 3440 - RNA, 21 nt, Homo sapiens
aaaggccacauccagcaccgu

SEQ ID NO: 3441 - RNA, 23 nt, Homo sapiens
ucagcaccaggauauuguuggag

SEQ ID NO: 3442 - RNA, 23 nt, Homo sapiens
cuccaacaauauccuggugcuga

SEQ ID NO: 3443 - RNA, 23 nt, Homo sapiens
ucaacaaaaucacugaugcugga

SEQ ID NO: 3444 - RNA, 23 nt, Homo sapiens
uccagcaucagugauuuuguuga

SEQ ID NO: 3445 - RNA, 22 nt, Homo sapiens
aacaauauccuggugcugagug

SEQ ID NO: 3446 - RNA, 22 nt, Homo sapiens
cacucagcaccaggauauuguu

SEQ ID NO: 3447 - RNA, 23 nt, Homo sapiens
ggcagguucucacccucucuagg

SEQ ID NO: 3448 - RNA, 23 nt, Homo sapiens
ccuagagagggugagaaccugcc

SEQ ID NO: 3449 - RNA, 23 nt, Homo sapiens
gacacgggcgacagcugcggccc

SEQ ID NO: 3450 - RNA, 23 nt, Homo sapiens
gggccgcagcugucgcccguguc

SEQ ID NO: 3451 - RNA, 21 nt, Homo sapiens
auguaugugugcaugugcaug

SEQ ID NO: 3452 - RNA, 21 nt, Homo sapiens
caugcacaugcacacauacau

SEQ ID NO: 3453 - RNA, 22 nt, Homo sapiens
uauacaagggcagacucucucu

SEQ ID NO: 3454 - RNA, 22 nt, Homo sapiens
agagagagucugcccuuguaua

SEQ ID NO: 3455 - RNA, 20 nt, Homo sapiens
ggcggcggcggaggcggggg

SEQ ID NO: 3456 - RNA, 20 nt, Homo sapiens
cccccgccuccgccgccgcc

SEQ ID NO: 3457 - RNA, 22 nt, Homo sapiens
gcaggugcucacuuguccuccu

SEQ ID NO: 3458 - RNA, 22 nt, Homo sapiens
aggaggacaagugagcaccugc

SEQ ID NO: 3459 - RNA, 19 nt, Homo sapiens
ggggccuggcggugggcgg

SEQ ID NO: 3460 - RNA, 19 nt, Homo sapiens
ccgcccaccgccaggcccc

SEQ ID NO: 3461 - RNA, 22 nt, Homo sapiens
gcccaaaggugaauuuuuuggg

SEQ ID NO: 3462 - RNA, 22 nt, Homo sapiens
cccaaaaaauucaccuuugggc

SEQ ID NO: 3463 - RNA, 22 nt, Homo sapiens
caaagaauucuccuuuugggcu

SEQ ID NO: 3464 - RNA, 22 nt, Homo sapiens
agcccaaaaggagaauucuuug

SEQ ID NO: 3465 - RNA, 22 nt, Homo sapiens
cugcaauguaagcacuucuuac

SEQ ID NO: 3466 - RNA, 22 nt, Homo sapiens
guaagaagugcuuacauugcag

SEQ ID NO: 3467 - RNA, 23 nt, Homo sapiens
aaaagugcuuacagugcagguag

SEQ ID NO: 3468 - RNA, 23 nt, Homo sapiens
cuaccugcacuguaagcacuuuu

SEQ ID NO: 3469 - RNA, 22 nt, Homo sapiens
acuguaguaugggcacuuccag

SEQ ID NO: 3470 - RNA, 22 nt, Homo sapiens
cuggaagugcccauacuacagu

SEQ ID NO: 3471 - RNA, 23 nt, Homo sapiens
caaagugcucauagugcagguag

SEQ ID NO: 3472 - RNA, 23 nt, Homo sapiens
cuaccugcacuaugagcacuuug

SEQ ID NO: 3473 - RNA, 23 nt, Homo sapiens
gggguauuguuuccgcugccagg

SEQ ID NO: 3474 - RNA, 23 nt, Homo sapiens
ccuggcagcggaaacaauacccc

SEQ ID NO: 3475 - RNA, 23 nt, Homo sapiens
uagcagcgggaacaguucugcag

SEQ ID NO: 3476 - RNA, 23 nt, Homo sapiens
cugcagaacuguucccgcugcua

SEQ ID NO: 3477 - RNA, 21 nt, Homo sapiens
cgagccucaagcaagggacuu

SEQ ID NO: 3478 - RNA, 21 nt, Homo sapiens
aagucccuugcuugaggcucg

SEQ ID NO: 3479 - RNA, 22 nt, Homo sapiens
uagucccuuccuugaagcgguc

SEQ ID NO: 3480 - RNA, 22 nt, Homo sapiens
gaccgcuucaaggaagggacua

SEQ ID NO: 3481 - RNA, 21 nt, Homo sapiens
acuggacuuggagucagaagg

SEQ ID NO: 3482 - RNA, 21 nt, Homo sapiens
ccuucugacuccaaguccagu

SEQ ID NO: 3483 - RNA, 22 nt, Homo sapiens
cuccugacuccagguccugugu

SEQ ID NO: 3484 - RNA, 22 nt, Homo sapiens
acacaggaccuggagucaggag

SEQ ID NO: 3485 - RNA, 22 nt, Homo sapiens
uuuguucguucggcucgcguga

SEQ ID NO: 3486 - RNA, 22 nt, Homo sapiens
ucacgcgagccgaacgaacaaa

SEQ ID NO: 3487 - RNA, 22 nt, Homo sapiens
acggauguuugagcaugugcua

SEQ ID NO: 3488 - RNA, 22 nt, Homo sapiens
uagcacaugcucaaacauccgu

SEQ ID NO: 3489 - RNA, 23 nt, Homo sapiens
ucaaaugcucagacuccuguggu

SEQ ID NO: 3490 - RNA, 23 nt, Homo sapiens
accacaggagucugagcauuuga

SEQ ID NO: 3491 - RNA, 22 nt, Homo sapiens
cggcaacaagaaacugccugag

SEQ ID NO: 3492 - RNA, 22 nt, Homo sapiens
cucaggcaguuucuuguugccg

SEQ ID NO: 3493 - RNA, 22 nt, Homo sapiens
uagguaguuucauguuguuggg

SEQ ID NO: 3494 - RNA, 22 nt, Homo sapiens
cccaacaacaugaaacuaccua

SEQ ID NO: 3495 - RNA, 22 nt, Homo sapiens
caauguuuccacagugcaucac

SEQ ID NO: 3496 - RNA, 22 nt, Homo sapiens
gugaugcacuguggaaacauug

SEQ ID NO: 3497 - RNA, 21 nt, Homo sapiens
gugcauuguaguugcauugca

SEQ ID NO: 3498 - RNA, 21 nt, Homo sapiens
ugcaaugcaacuacaaugcac

SEQ ID NO: 3499 - RNA, 18 nt, Homo sapiens
aucccaccucugccacca

SEQ ID NO: 3500 - RNA, 18 nt, Homo sapiens
ugguggcagaggugggau

SEQ ID NO: 3501 - RNA, 19 nt, Homo sapiens
aucccaccacugccaccau

SEQ ID NO: 3502 - RNA, 19 nt, Homo sapiens
augguggcaguggugggau

SEQ ID NO: 3503 - RNA, 22 nt, Homo sapiens
accuuccucuccaugggucuuu

SEQ ID NO: 3504 - RNA, 22 nt, Homo sapiens
aaagacccauggagaggaaggu

SEQ ID NO: 3505 - RNA, 22 nt, Homo sapiens
aaagacccauugaggagaaggu

SEQ ID NO: 3506 - RNA, 22 nt, Homo sapiens
accuucuccucaaugggucuuu

SEQ ID NO: 3507 - RNA, 21 nt, Homo sapiens
aauguagagauugaucaaaau

SEQ ID NO: 3508 - RNA, 21 nt, Homo sapiens
auuuugaucaaucucuacauu

SEQ ID NO: 3509 - RNA, 23 nt, Homo sapiens
acggaauauguauacggaauaua

SEQ ID NO: 3510 - RNA, 23 nt, Homo sapiens
uauauuccguauacauauuccgu

SEQ ID NO: 3511 - RNA, 24 nt, Homo sapiens
agagcucacagcuguccuucucua

SEQ ID NO: 3512 - RNA, 24 nt, Homo sapiens
uagagaaggacagcugugagcucu

SEQ ID NO: 3513 - RNA, 22 nt, Homo sapiens
aucaaauaaggacuagucugca

SEQ ID NO: 3514 - RNA, 22 nt, Homo sapiens
ugcagacuaguccuuauuugau

SEQ ID NO: 3515 - RNA, 23 nt, Homo sapiens
augagacucauguaaaacaucuu

SEQ ID NO: 3516 - RNA, 23 nt, Homo sapiens
aagauguuuuacaugagucucau

SEQ ID NO: 3517 - RNA, 21 nt, Homo sapiens
auggaauguauauacggaaua

SEQ ID NO: 3518 - RNA, 21 nt, Homo sapiens
uauuccguauauacauuccau

SEQ ID NO: 3519 - RNA, 22 nt, Homo sapiens
auuguagaaccuaagauuggcc

SEQ ID NO: 3520 - RNA, 22 nt, Homo sapiens
ggccaaucuuagguucuacaau

SEQ ID NO: 3521 - RNA, 22 nt, Homo sapiens
caucucuaaggaacucccccaa

SEQ ID NO: 3522 - RNA, 22 nt, Homo sapiens
uugggggaguuccuuagagaug

SEQ ID NO: 3523 - RNA, 23 nt, Homo sapiens
uauggggcuucuguagagauuuc

SEQ ID NO: 3524 - RNA, 23 nt, Homo sapiens
gaaaucucuacagaagccccaua

SEQ ID NO: 3525 - RNA, 20 nt, Homo sapiens
ccguguuucccccacgcuuu

SEQ ID NO: 3526 - RNA, 20 nt, Homo sapiens
aaagcgugggggaaacacgg

SEQ ID NO: 3527 - RNA, 15 nt, Homo sapiens
aggagauccuggguu

SEQ ID NO: 3528 - RNA, 15 nt, Homo sapiens
aacccaggaucuccu

SEQ ID NO: 3529 - RNA, 22 nt, Homo sapiens
cucgugggcucuggccacggcc

SEQ ID NO: 3530 - RNA, 22 nt, Homo sapiens
ggccguggccagagcccacgag

SEQ ID NO: 3531 - RNA, 22 nt, Homo sapiens
caguggccagagcccugcagug

SEQ ID NO: 3532 - RNA, 22 nt, Homo sapiens
cacugcagggcucuggccacug

SEQ ID NO: 3533 - RNA, 22 nt, Homo sapiens
cugcagaguuuguacggaccgg

SEQ ID NO: 3534 - RNA, 22 nt, Homo sapiens
ccgguccguacaaacucugcag

SEQ ID NO: 3535 - RNA, 20 nt, Homo sapiens
uccguacaaacucugcugug

SEQ ID NO: 3536 - RNA, 20 nt, Homo sapiens
cacagcagaguuuguacgga

SEQ ID NO: 3537 - RNA, 22 nt, Homo sapiens
cuuccccccaguaaucuucauc

SEQ ID NO: 3538 - RNA, 22 nt, Homo sapiens
gaugaagauuacuggggggaag

SEQ ID NO: 3539 - RNA, 23 nt, Homo sapiens
ugaggauauggcagggaagggga

SEQ ID NO: 3540 - RNA, 23 nt, Homo sapiens
uccccuucccugccauauccuca

SEQ ID NO: 3541 - RNA, 23 nt, Homo sapiens
uuuugcaugacccugggaguagg

SEQ ID NO: 3542 - RNA, 23 nt, Homo sapiens
ccuacucccagggucaugcaaaa

SEQ ID NO: 3543 - RNA, 22 nt, Homo sapiens
gacucacucacaggauugugca

SEQ ID NO: 3544 - RNA, 22 nt, Homo sapiens
ugcacaauccugugagugaguc

SEQ ID NO: 3545 - RNA, 22 nt, Homo sapiens
acacagugcuucauccacuacu

SEQ ID NO: 3546 - RNA, 22 nt, Homo sapiens
aguaguggaugaagcacugugu

SEQ ID NO: 3547 - RNA, 22 nt, Homo sapiens
uaguggaugaugcacucugugc

SEQ ID NO: 3548 - RNA, 22 nt, Homo sapiens
gcacagagugcaucauccacua

SEQ ID NO: 3549 - RNA, 21 nt, Homo sapiens
ugaugauacagguggagguag

SEQ ID NO: 3550 - RNA, 21 nt, Homo sapiens
cuaccuccaccuguaucauca

SEQ ID NO: 3551 - RNA, 22 nt, Homo sapiens
cuacuucuaccuguguuaucau

SEQ ID NO: 3552 - RNA, 22 nt, Homo sapiens
augauaacacagguagaaguag

SEQ ID NO: 3553 - RNA, 22 nt, Homo sapiens
ugcgacauuggaaguaguauca

SEQ ID NO: 3554 - RNA, 22 nt, Homo sapiens
ugauacuacuuccaaugucgca

SEQ ID NO: 3555 - RNA, 21 nt, Homo sapiens
uuagaccuaguacacguccuu

SEQ ID NO: 3556 - RNA, 21 nt, Homo sapiens
aaggacguguacuaggucuaa

SEQ ID NO: 3557 - RNA, 22 nt, Homo sapiens
uuuccuacccuaccugaagacu

SEQ ID NO: 3558 - RNA, 22 nt, Homo sapiens
agucuucagguaggguaggaaa

SEQ ID NO: 3559 - RNA, 22 nt, Homo sapiens
aucuguaagagaaaguaaauga

SEQ ID NO: 3560 - RNA, 22 nt, Homo sapiens
ucauuuacuuucucuuacagau

SEQ ID NO: 3561 - RNA, 24 nt, Homo sapiens
cccggacaggcguucgugcgacgu

SEQ ID NO: 3562 - RNA, 24 nt, Homo sapiens
acgucgcacgaacgccuguccggg

SEQ ID NO: 3563 - RNA, 23 nt, Homo sapiens
accuggacccagcguagacaaag

SEQ ID NO: 3564 - RNA, 23 nt, Homo sapiens
cuuugucuacgcuggguccaggu

SEQ ID NO: 3565 - RNA, 22 nt, Homo sapiens
accaagucugcgucauccucuc

SEQ ID NO: 3566 - RNA, 22 nt, Homo sapiens
gagaggaugacgcagacuuggu

SEQ ID NO: 3567 - RNA, 23 nt, Homo sapiens
aguggaugauggagacucgguac

SEQ ID NO: 3568 - RNA, 23 nt, Homo sapiens
guaccgagucuccaucauccacu

SEQ ID NO: 3569 - RNA, 24 nt, Homo sapiens
guuccacacugacacugcagaagu

SEQ ID NO: 3570 - RNA, 24 nt, Homo sapiens
acuucugcagugucaguguggaac

SEQ ID NO: 3571 - RNA, 24 nt, Homo sapiens
ccugcuggucaggaguggauacug

SEQ ID NO: 3572 - RNA, 24 nt, Homo sapiens
caguauccacuccugaccagcagg

SEQ ID NO: 3573 - RNA, 23 nt, Homo sapiens
gagggucuugggagggaugugac

SEQ ID NO: 3574 - RNA, 23 nt, Homo sapiens
gucacaucccucccaagacccuc

SEQ ID NO: 3575 - RNA, 22 nt, Homo sapiens
auauacagggggagacucuuau

SEQ ID NO: 3576 - RNA, 22 nt, Homo sapiens
auaagagucucccccuguauau

SEQ ID NO: 3577 - RNA, 22 nt, Homo sapiens
auauacagggggagacucucau

SEQ ID NO: 3578 - RNA, 22 nt, Homo sapiens
augagagucucccccuguauau

SEQ ID NO: 3579 - RNA, 21 nt, Homo sapiens
agaggauacccuuuguauguu

SEQ ID NO: 3580 - RNA, 21 nt, Homo sapiens
aacauacaaaggguauccucu

SEQ ID NO: 3581 - RNA, 22 nt, Homo sapiens
ucuacaaaggaaagcgcuuucu

SEQ ID NO: 3582 - RNA, 22 nt, Homo sapiens
agaaagcgcuuuccuuuguaga

SEQ ID NO: 3583 - RNA, 22 nt, Homo sapiens
ucaaaacugaggggcauuuucu

SEQ ID NO: 3584 - RNA, 22 nt, Homo sapiens
agaaaaugccccucaguuuuga

SEQ ID NO: 3585 - RNA, 24 nt, Homo sapiens
uucuccaaaagaaagcacuuucug

SEQ ID NO: 3586 - RNA, 24 nt, Homo sapiens
cagaaagugcuuucuuuuggagaa

SEQ ID NO: 3587 - RNA, 23 nt, Homo sapiens
uucucgaggaaagaagcacuuuc

SEQ ID NO: 3588 - RNA, 23 nt, Homo sapiens
gaaagugcuucuuuccucgagaa

SEQ ID NO: 3589 - RNA, 22 nt, Homo sapiens
ccucuagauggaagcacugucu

SEQ ID NO: 3590 - RNA, 22 nt, Homo sapiens
agacagugcuuccaucuagagg

SEQ ID NO: 3591 - RNA, 22 nt, Homo sapiens
aucgugcaucccuuuagagugu

SEQ ID NO: 3592 - RNA, 22 nt, Homo sapiens
acacucuaaagggaugcacgau

SEQ ID NO: 3593 - RNA, 22 nt, Homo sapiens
aucgugcaucccuuuagagugu

SEQ ID NO: 3594 - RNA, 22 nt, Homo sapiens
acacucuaaagggaugcacgau

SEQ ID NO: 3595 - RNA, 22 nt, Homo sapiens
aucgugcauccuuuuagagugu

SEQ ID NO: 3596 - RNA, 22 nt, Homo sapiens
acacucuaaaaggaugcacgau

SEQ ID NO: 3597 - RNA, 22 nt, Homo sapiens
caaagcgcuccccuuuagaggu

SEQ ID NO: 3598 - RNA, 22 nt, Homo sapiens
accucuaaaggggagcgcuuug

SEQ ID NO: 3599 - RNA, 23 nt, Homo sapiens
caaagcgcuucucuuuagagugu

SEQ ID NO: 3600 - RNA, 23 nt, Homo sapiens
acacucuaaagagaagcgcuuug

SEQ ID NO: 3601 - RNA, 23 nt, Homo sapiens
ucucuggagggaagcacuuucug

SEQ ID NO: 3602 - RNA, 23 nt, Homo sapiens
cagaaagugcuucccuccagaga

SEQ ID NO: 3603 - RNA, 21 nt, Homo sapiens
gaaagcgcuucucuuuagagg

SEQ ID NO: 3604 - RNA, 21 nt, Homo sapiens
ccucuaaagagaagcgcuuuc

SEQ ID NO: 3605 - RNA, 22 nt, Homo sapiens
cucuagagggaagcacuuucuc

SEQ ID NO: 3606 - RNA, 22 nt, Homo sapiens
gagaaagugcuucccucuagag

SEQ ID NO: 3607 - RNA, 22 nt, Homo sapiens
aaagugcauccuuuuagagugu

SEQ ID NO: 3608 - RNA, 22 nt, Homo sapiens
acacucuaaaaggaugcacuuu

SEQ ID NO: 3609 - RNA, 22 nt, Homo sapiens
cucuagagggaagcgcuuucug

SEQ ID NO: 3610 - RNA, 22 nt, Homo sapiens
cagaaagcgcuucccucuagag

SEQ ID NO: 3611 - RNA, 22 nt, Homo sapiens
caaagugccucccuuuagagug

SEQ ID NO: 3612 - RNA, 22 nt, Homo sapiens
cacucuaaagggaggcacuuug

SEQ ID NO: 3613 - RNA, 22 nt, Homo sapiens
aagugccuccuuuuagaguguu

SEQ ID NO: 3614 - RNA, 22 nt, Homo sapiens
aacacucuaaaaggaggcacuu

SEQ ID NO: 3615 - RNA, 22 nt, Homo sapiens
uucuccaaaagggagcacuuuc

SEQ ID NO: 3616 - RNA, 22 nt, Homo sapiens
gaaagugcucccuuuuggagaa

SEQ ID NO: 3617 - RNA, 22 nt, Homo sapiens
aaagugcuucccuuuggacugu

SEQ ID NO: 3618 - RNA, 22 nt, Homo sapiens
acaguccaaagggaagcacuuu

SEQ ID NO: 3619 - RNA, 21 nt, Homo sapiens
cuccagagggaaguacuuucu

SEQ ID NO: 3620 - RNA, 21 nt, Homo sapiens
agaaaguacuucccucuggag

SEQ ID NO: 3621 - RNA, 22 nt, Homo sapiens
acaaagugcuucccuuuagagu

SEQ ID NO: 3622 - RNA, 22 nt, Homo sapiens
acucuaaagggaagcacuuugu

SEQ ID NO: 3623 - RNA, 22 nt, Homo sapiens
cuacaaagggaagcacuuucuc

SEQ ID NO: 3624 - RNA, 22 nt, Homo sapiens
gagaaagugcuucccuuuguag

SEQ ID NO: 3625 - RNA, 22 nt, Homo sapiens
gaaggcgcuucccuuuagagcg

SEQ ID NO: 3626 - RNA, 22 nt, Homo sapiens
cgcucuaaagggaagcgccuuc

SEQ ID NO: 3627 - RNA, 21 nt, Homo sapiens
cuccagagggaugcacuuucu

SEQ ID NO: 3628 - RNA, 21 nt, Homo sapiens
agaaagugcaucccucuggag

SEQ ID NO: 3629 - RNA, 22 nt, Homo sapiens
cucuagagggaagcacuuucug

SEQ ID NO: 3630 - RNA, 22 nt, Homo sapiens
cagaaagugcuucccucuagag

SEQ ID NO: 3631 - RNA, 22 nt, Homo sapiens
gaaagugcuuccuuuuagaggc

SEQ ID NO: 3632 - RNA, 22 nt, Homo sapiens
gccucuaaaaggaagcacuuuc

SEQ ID NO: 3633 - RNA, 23 nt, Homo sapiens
cucuugagggaagcacuuucugu

SEQ ID NO: 3634 - RNA, 23 nt, Homo sapiens
acagaaagugcuucccucaagag

SEQ ID NO: 3635 - RNA, 22 nt, Homo sapiens
acuggacuuagggucagaaggc

SEQ ID NO: 3636 - RNA, 22 nt, Homo sapiens
gccuucugacccuaaguccagu

SEQ ID NO: 3637 - RNA, 22 nt, Homo sapiens
aaacaaacauggugcacuucuu

SEQ ID NO: 3638 - RNA, 22 nt, Homo sapiens
aagaagugcaccauguuuguuu

SEQ ID NO: 3639 - RNA, 22 nt, Homo sapiens
gaaguugcccauguuauuuucg

SEQ ID NO: 3640 - RNA, 22 nt, Homo sapiens
cgaaaauaacaugggcaacuuc

SEQ ID NO: 3641 - RNA, 21 nt, Homo sapiens
aaucauucacggacaacacuu

SEQ ID NO: 3642 - RNA, 21 nt, Homo sapiens
aaguguuguccgugaaugauu

SEQ ID NO: 3643 - RNA, 22 nt, Homo sapiens
gaaguuguucgugguggauucg

SEQ ID NO: 3644 - RNA, 22 nt, Homo sapiens
cgaauccaccacgaacaacuuc

SEQ ID NO: 3645 - RNA, 23 nt, Homo sapiens
ccuccguguuaccuguccucuag

SEQ ID NO: 3646 - RNA, 23 nt, Homo sapiens
cuagaggacagguaacacggagg

SEQ ID NO: 3647 - RNA, 23 nt, Homo sapiens
ugaggauggauagcaaggaagcc

SEQ ID NO: 3648 - RNA, 23 nt, Homo sapiens
ggcuuccuugcuauccauccuca

SEQ ID NO: 3649 - RNA, 22 nt, Homo sapiens
uucagaucccagcggugccucu

SEQ ID NO: 3650 - RNA, 22 nt, Homo sapiens
agaggcaccgcugggaucugaa

SEQ ID NO: 3651 - RNA, 19 nt, Homo sapiens
guccuaggaggcuccucug

SEQ ID NO: 3652 - RNA, 19 nt, Homo sapiens
cagaggagccuccuaggac

SEQ ID NO: 3653 - RNA, 21 nt, Homo sapiens
caauucucaaaggagccuccc

SEQ ID NO: 3654 - RNA, 21 nt, Homo sapiens
gggaggcuccuuugagaauug

SEQ ID NO: 3655 - RNA, 21 nt, Homo sapiens
guuggggugcaggggucugcu

SEQ ID NO: 3656 - RNA, 21 nt, Homo sapiens
agcagaccccugcaccccaac

SEQ ID NO: 3657 - RNA, 22 nt, Homo sapiens
uuuccggcucgcgugggugugu

SEQ ID NO: 3658 - RNA, 22 nt, Homo sapiens
acacacccacgcgagccggaaa

SEQ ID NO: 3659 - RNA, 23 nt, Homo sapiens
ugagugugugugugugagugugu

SEQ ID NO: 3660 - RNA, 23 nt, Homo sapiens
acacacucacacacacacacuca

SEQ ID NO: 3661 - RNA, 22 nt, Homo sapiens
agugggaggccagggcacggca

SEQ ID NO: 3662 - RNA, 22 nt, Homo sapiens
ugccgugcccuggccucccacu

SEQ ID NO: 3663 - RNA, 20 nt, Homo sapiens
ugagcccuguccucccgcag

SEQ ID NO: 3664 - RNA, 20 nt, Homo sapiens
cugcgggaggacagggcuca

SEQ ID NO: 3665 - RNA, 23 nt, Homo sapiens
aagugccgccaucuuuugagugu

SEQ ID NO: 3666 - RNA, 23 nt, Homo sapiens
acacucaaaagauggcggcacuu

SEQ ID NO: 3667 - RNA, 20 nt, Homo sapiens
acucaaacugugggggcacu

SEQ ID NO: 3668 - RNA, 20 nt, Homo sapiens
agugcccccacaguuugagu

SEQ ID NO: 3669 - RNA, 23 nt, Homo sapiens
aagugcccccacaguuugagugc

SEQ ID NO: 3670 - RNA, 23 nt, Homo sapiens
gcacucaaacugugggggcacuu

SEQ ID NO: 3671 - RNA, 22 nt, Homo sapiens
acucaaaagauggcggcacuuu

SEQ ID NO: 3672 - RNA, 22 nt, Homo sapiens
aaagugccgccaucuuuugagu

SEQ ID NO: 3673 - RNA, 22 nt, Homo sapiens
aaaccuguguuguucaagaguc

SEQ ID NO: 3674 - RNA, 22 nt, Homo sapiens
gacucuugaacaacacagguuu

SEQ ID NO: 3675 - RNA, 22 nt, Homo sapiens
acaguagagggaggaaucgcag

SEQ ID NO: 3676 - RNA, 22 nt, Homo sapiens
cugcgauuccucccucuacugu

SEQ ID NO: 3677 - RNA, 22 nt, Homo sapiens
gugaaauguuuaggaccacuag

SEQ ID NO: 3678 - RNA, 22 nt, Homo sapiens
cuagugguccuaaacauuucac

SEQ ID NO: 3679 - RNA, 23 nt, Homo sapiens
uugaacuguuaagaaccacugga

SEQ ID NO: 3680 - RNA, 23 nt, Homo sapiens
uccagugguucuuaacaguucaa

SEQ ID NO: 3681 - RNA, 22 nt, Homo sapiens
uagugguccuaaacauuucaca

SEQ ID NO: 3682 - RNA, 22 nt, Homo sapiens
ugugaaauguuuaggaccacua

SEQ ID NO: 3683 - RNA, 21 nt, Homo sapiens
ugcaggaccaagaugagcccu

SEQ ID NO: 3684 - RNA, 21 nt, Homo sapiens
agggcucaucuugguccugca

SEQ ID NO: 3685 - RNA, 21 nt, Homo sapiens
cucccacaugcaggguuugca

SEQ ID NO: 3686 - RNA, 21 nt, Homo sapiens
ugcaaacccugcaugugggag

SEQ ID NO: 3687 - RNA, 21 nt, Homo sapiens
caucccuugcaugguggaggg

SEQ ID NO: 3688 - RNA, 21 nt, Homo sapiens
cccuccaccaugcaagggaug

SEQ ID NO: 3689 - RNA, 22 nt, Homo sapiens
aaaaugaaaugagcccagccca

SEQ ID NO: 3690 - RNA, 22 nt, Homo sapiens
ugggcugggcucauuucauuuu

SEQ ID NO: 3691 - RNA, 21 nt, Homo sapiens
agccgcggggaucgccgaggg

SEQ ID NO: 3692 - RNA, 21 nt, Homo sapiens
cccucggcgauccccgcggcu

SEQ ID NO: 3693 - RNA, 19 nt, Homo sapiens
agggaccugagugucuaag

SEQ ID NO: 3694 - RNA, 19 nt, Homo sapiens
cuuagacacucaggucccu

SEQ ID NO: 3695 - RNA, 19 nt, Homo sapiens
aggugugucuguagagucc

SEQ ID NO: 3696 - RNA, 19 nt, Homo sapiens
ggacucuacagacacaccu

SEQ ID NO: 3697 - RNA, 24 nt, Homo sapiens
cauagcccggucgcugguacauga

SEQ ID NO: 3698 - RNA, 24 nt, Homo sapiens
ucauguaccagcgaccgggcuaug

SEQ ID NO: 3699 - RNA, 18 nt, Homo sapiens
cggcuggaggugugagga

SEQ ID NO: 3700 - RNA, 18 nt, Homo sapiens
uccucacaccuccagccg

SEQ ID NO: 3701 - RNA, 18 nt, Homo sapiens
cuaagaaguugacugaag

SEQ ID NO: 3702 - RNA, 18 nt, Homo sapiens
cuucagucaacuucuuag

SEQ ID NO: 3703 - RNA, 19 nt, Homo sapiens
gacuggacaagcugaggaa

SEQ ID NO: 3704 - RNA, 19 nt, Homo sapiens
uuccucagcuuguccaguc

SEQ ID NO: 3705 - RNA, 21 nt, Homo sapiens
gcuugucgcugcgguguugcu

SEQ ID NO: 3706 - RNA, 21 nt, Homo sapiens
agcaacaccgcagcgacaagc

SEQ ID NO: 3707 - RNA, 17 nt, Homo sapiens
ggcgggugcgggggugg

SEQ ID NO: 3708 - RNA, 17 nt, Homo sapiens
ccacccccgcacccgcc

SEQ ID NO: 3709 - RNA, 21 nt, Homo sapiens
ugugucccauuauuggugauu

SEQ ID NO: 3710 - RNA, 21 nt, Homo sapiens
aaucaccaauaaugggacaca

SEQ ID NO: 3711 - RNA, 22 nt, Homo sapiens
uuuaagaaaacaccauggagau

SEQ ID NO: 3712 - RNA, 22 nt, Homo sapiens
aucuccaugguguuuucuuaaa

SEQ ID NO: 3713 - RNA, 22 nt, Homo sapiens
gcuauuucacgacaccaggguu

SEQ ID NO: 3714 - RNA, 22 nt, Homo sapiens
aacccuggugucgugaaauagc

SEQ ID NO: 3715 - RNA, 23 nt, Homo sapiens
agcugguguugugaaucaggccg

SEQ ID NO: 3716 - RNA, 23 nt, Homo sapiens
cggccugauucacaacaccagcu

SEQ ID NO: 3717 - RNA, 21 nt, Homo sapiens
aauaauacaugguugaucuuu

SEQ ID NO: 3718 - RNA, 21 nt, Homo sapiens
aaagaucaaccauguauuauu

SEQ ID NO: 3719 - RNA, 22 nt, Homo sapiens
agaucgaccguguuauauucgc

SEQ ID NO: 3720 - RNA, 22 nt, Homo sapiens
gcgaauauaacacggucgaucu

SEQ ID NO: 3721 - RNA, 22 nt, Homo sapiens
aaucaugugcagugccaauaug

SEQ ID NO: 3722 - RNA, 22 nt, Homo sapiens
cauauuggcacugcacaugauu

SEQ ID NO: 3723 - RNA, 23 nt, Homo sapiens
uuuggcacuagcacauuuuugcu

SEQ ID NO: 3724 - RNA, 23 nt, Homo sapiens
agcaaaaaugugcuagugccaaa

SEQ ID NO: 3725 - RNA, 22 nt, Homo sapiens
uccuguacugagcugccccgag

SEQ ID NO: 3726 - RNA, 22 nt, Homo sapiens
cucggggcagcucaguacagga

SEQ ID NO: 3727 - RNA, 22 nt, Homo sapiens
gcuacuucacaacaccagggcc

SEQ ID NO: 3728 - RNA, 22 nt, Homo sapiens
ggcccugguguugugaaguagc

SEQ ID NO: 3729 - RNA, 22 nt, Homo sapiens
caucaucgucucaaaugagucu

SEQ ID NO: 3730 - RNA, 22 nt, Homo sapiens
agacucauuugagacgaugaug

SEQ ID NO: 3731 - RNA, 23 nt, Homo sapiens
acuccauuuguuuugaugaugga

SEQ ID NO: 3732 - RNA, 23 nt, Homo sapiens
uccaucaucaaaacaaauggagu

SEQ ID NO: 3733 - RNA, 22 nt, Homo sapiens
cuccuacauauuagcauuaaca

SEQ ID NO: 3734 - RNA, 22 nt, Homo sapiens
uguuaaugcuaauauguaggag

SEQ ID NO: 3735 - RNA, 23 nt, Homo sapiens
uuaaugcuaaucgugauaggggu

SEQ ID NO: 3736 - RNA, 23 nt, Homo sapiens
accccuaucacgauuagcauuaa

SEQ ID NO: 3737 - RNA, 22 nt, Homo sapiens
agaucagaaggugauuguggcu

SEQ ID NO: 3738 - RNA, 22 nt, Homo sapiens
agccacaaucaccuucugaucu

SEQ ID NO: 3739 - RNA, 22 nt, Homo sapiens
uacugcagacguggcaaucaug

SEQ ID NO: 3740 - RNA, 22 nt, Homo sapiens
caugauugccacgucugcagua

SEQ ID NO: 3741 - RNA, 21 nt, Homo sapiens
guuagggccaacaucucuugg

SEQ ID NO: 3742 - RNA, 21 nt, Homo sapiens
ccaagagauguuggcccuaac

SEQ ID NO: 3743 - RNA, 21 nt, Homo sapiens
aacauagaggaaauuccacgu

SEQ ID NO: 3744 - RNA, 21 nt, Homo sapiens
acguggaauuuccucuauguu

SEQ ID NO: 3745 - RNA, 21 nt, Homo sapiens
gguggauauuccuucuauguu

SEQ ID NO: 3746 - RNA, 21 nt, Homo sapiens
aacauagaaggaauauccacc

SEQ ID NO: 3747 - RNA, 23 nt, Homo sapiens
ucauagcccuguacaaugcugcu

SEQ ID NO: 3748 - RNA, 23 nt, Homo sapiens
agcagcauuguacagggcuauga

SEQ ID NO: 3749 - RNA, 22 nt, Homo sapiens
uaacacugucugguaaagaugg

SEQ ID NO: 3750 - RNA, 22 nt, Homo sapiens
ccaucuuuaccagacaguguua

SEQ ID NO: 3751 - RNA, 22 nt, Homo sapiens
caucuuccaguacaguguugga

SEQ ID NO: 3752 - RNA, 22 nt, Homo sapiens
uccaacacuguacuggaagaug

SEQ ID NO: 3753 - RNA, 22 nt, Homo sapiens
aacuggccuacaaagucccagu

SEQ ID NO: 3754 - RNA, 22 nt, Homo sapiens
acugggacuuuguaggccaguu

SEQ ID NO: 3755 - RNA, 22 nt, Homo sapiens
ugggucuuugcgggcgagauga

SEQ ID NO: 3756 - RNA, 22 nt, Homo sapiens
ucaucucgcccgcaaagaccca

SEQ ID NO: 3757 - RNA, 21 nt, Homo sapiens
augaccuaugaauugacagac

SEQ ID NO: 3758 - RNA, 21 nt, Homo sapiens
gucugucaauucauaggucau

SEQ ID NO: 3759 - RNA, 22 nt, Homo sapiens
aagcugccaguugaagaacugu

SEQ ID NO: 3760 - RNA, 22 nt, Homo sapiens
acaguucuucaacuggcagcuu

SEQ ID NO: 3761 - RNA, 22 nt, Homo sapiens
aguucuucaguggcaagcuuua

SEQ ID NO: 3762 - RNA, 22 nt, Homo sapiens
uaaagcuugccacugaagaacu

SEQ ID NO: 3763 - RNA, 22 nt, Homo sapiens
acagauucgauucuaggggaau

SEQ ID NO: 3764 - RNA, 22 nt, Homo sapiens
auuccccuagaaucgaaucugu

SEQ ID NO: 3765 - RNA, 23 nt, Homo sapiens
uacccuguagaaccgaauuugug

SEQ ID NO: 3766 - RNA, 23 nt, Homo sapiens
cacaaauucgguucuacagggua

SEQ ID NO: 3767 - RNA, 22 nt, Homo sapiens
uagcagcacguaaauauuggcg

SEQ ID NO: 3768 - RNA, 22 nt, Homo sapiens
cgccaauauuuacgugcugcua

SEQ ID NO: 3769 - RNA, 21 nt, Homo sapiens
ugagaugaagcacuguagcuc

SEQ ID NO: 3770 - RNA, 21 nt, Homo sapiens
gagcuacagugcuucaucuca

SEQ ID NO: 3771 - RNA, 22 nt, Homo sapiens
ggugcagugcugcaucucuggu

SEQ ID NO: 3772 - RNA, 22 nt, Homo sapiens
accagagaugcagcacugcacc

SEQ ID NO: 3773 - RNA, 21 nt, Homo sapiens
uugcucacuguucuucccuag

SEQ ID NO: 3774 - RNA, 21 nt, Homo sapiens
cuagggaagaacagugagcaa

SEQ ID NO: 3775 - RNA, 18 nt, Homo sapiens
cagggucagcugagcaug

SEQ ID NO: 3776 - RNA, 18 nt, Homo sapiens
caugcucagcugacccug

SEQ ID NO: 3777 - RNA, 21 nt, Homo sapiens
aagcauucuuucauugguugg

SEQ ID NO: 3778 - RNA, 21 nt, Homo sapiens
ccaaccaaugaaagaaugcuu

SEQ ID NO: 3779 - RNA, 21 nt, Homo sapiens
ccgucgccgccacccgagccg

SEQ ID NO: 3780 - RNA, 21 nt, Homo sapiens
cggcucggguggcggcgacgg

SEQ ID NO: 3781 - RNA, 27 nt, Homo sapiens
cacuguaggugauggugagagugggca

SEQ ID NO: 3782 - RNA, 27 nt, Homo sapiens
ugcccacucucaccaucaccuacagug

SEQ ID NO: 3783 - RNA, 23 nt, Homo sapiens
gggaugguagaccggugacgugc

SEQ ID NO: 3784 - RNA, 23 nt, Homo sapiens
gcacgucaccggucuaccauccc

SEQ ID NO: 3785 - RNA, 21 nt, Homo sapiens
uaggacacauggucuacuucu

SEQ ID NO: 3786 - RNA, 21 nt, Homo sapiens
agaaguagaccauguguccua

SEQ ID NO: 3787 - RNA, 22 nt, Homo sapiens
cuccugagccauucugagccuc

SEQ ID NO: 3788 - RNA, 22 nt, Homo sapiens
gaggcucagaauggcucaggag

SEQ ID NO: 3789 - RNA, 21 nt, Homo sapiens
gugccagcugcagugggggag

SEQ ID NO: 3790 - RNA, 21 nt, Homo sapiens
cucccccacugcagcuggcac

SEQ ID NO: 3791 - RNA, 21 nt, Homo sapiens
cccggagccaggaugcagcuc

SEQ ID NO: 3792 - RNA, 21 nt, Homo sapiens
gagcugcauccuggcuccggg

SEQ ID NO: 3793 - RNA, 21 nt, Homo sapiens
ucguggccuggucuccauuau

SEQ ID NO: 3794 - RNA, 21 nt, Homo sapiens
auaauggagaccaggccacga

SEQ ID NO: 3795 - RNA, 20 nt, Homo sapiens
ucugcaggguuugcuuugag

SEQ ID NO: 3796 - RNA, 20 nt, Homo sapiens
cucaaagcaaacccugcaga

SEQ ID NO: 3797 - RNA, 21 nt, Homo sapiens
uguucauguagauguuuaagc

SEQ ID NO: 3798 - RNA, 21 nt, Homo sapiens
gcuuaaacaucuacaugaaca

SEQ ID NO: 3799 - RNA, 18 nt, Homo sapiens
ucagcuggcccucauuuc

SEQ ID NO: 3800 - RNA, 18 nt, Homo sapiens
gaaaugagggccagcuga

SEQ ID NO: 3801 - RNA, 21 nt, Homo sapiens
uggcagggaggcugggagggg

SEQ ID NO: 3802 - RNA, 21 nt, Homo sapiens
ccccucccagccucccugcca

SEQ ID NO: 3803 - RNA, 20 nt, Homo sapiens
ucacuguucagacaggcgga

SEQ ID NO: 3804 - RNA, 20 nt, Homo sapiens
uccgccugucugaacaguga

SEQ ID NO: 3805 - RNA, 21 nt, Homo sapiens
ccccaccuccucucuccucag

SEQ ID NO: 3806 - RNA, 21 nt, Homo sapiens
cugaggagagaggaggugggg

SEQ ID NO: 3807 - RNA, 19 nt, Homo sapiens
gugaggacucgggaggugg

SEQ ID NO: 3808 - RNA, 19 nt, Homo sapiens
ccaccucccgaguccucac

SEQ ID NO: 3809 - RNA, 22 nt, Homo sapiens
ugagccccugugccgcccccag

SEQ ID NO: 3810 - RNA, 22 nt, Homo sapiens
cugggggcggcacaggggcuca

SEQ ID NO: 3811 - RNA, 22 nt, Homo sapiens
guggguacggcccagugggggg

SEQ ID NO: 3812 - RNA, 22 nt, Homo sapiens
ccccccacugggccguacccac

SEQ ID NO: 3813 - RNA, 22 nt, Homo sapiens
ucaccagcccuguguucccuag

SEQ ID NO: 3814 - RNA, 22 nt, Homo sapiens
cuagggaacacagggcugguga

SEQ ID NO: 3815 - RNA, 26 nt, Homo sapiens
gugagggcaugcaggccuggaugggg

SEQ ID NO: 3816 - RNA, 26 nt, Homo sapiens
ccccauccaggccugcaugcccucac

SEQ ID NO: 3817 - RNA, 23 nt, Homo sapiens
cucucaccacugcccucccacag

SEQ ID NO: 3818 - RNA, 23 nt, Homo sapiens
cugugggagggcaguggugagag

SEQ ID NO: 3819 - RNA, 24 nt, Homo sapiens
guggguaggguuugggggagagcg

SEQ ID NO: 3820 - RNA, 24 nt, Homo sapiens
cgcucucccccaaacccuacccac

SEQ ID NO: 3821 - RNA, 20 nt, Homo sapiens
gugucugggcggacagcugc

SEQ ID NO: 3822 - RNA, 20 nt, Homo sapiens
gcagcuguccgcccagacac

SEQ ID NO: 3823 - RNA, 20 nt, Homo sapiens
cuuccucgucugucugcccc

SEQ ID NO: 3824 - RNA, 20 nt, Homo sapiens
ggggcagacagacgaggaag

SEQ ID NO: 3825 - RNA, 23 nt, Homo sapiens
gugagugggagccccagugugug

SEQ ID NO: 3826 - RNA, 23 nt, Homo sapiens
cacacacuggggcucccacucac

SEQ ID NO: 3827 - RNA, 27 nt, Homo sapiens
accuucuuguauaagcacugugcuaaa

SEQ ID NO: 3828 - RNA, 27 nt, Homo sapiens
uuuagcacagugcuuauacaagaaggu

SEQ ID NO: 3829 - RNA, 22 nt, Homo sapiens
ggcgacaaaacgagacccuguc

SEQ ID NO: 3830 - RNA, 22 nt, Homo sapiens
gacagggucucguuuugucgcc

SEQ ID NO: 3831 - RNA, 22 nt, Homo sapiens
uugcuugaacccaggaagugga

SEQ ID NO: 3832 - RNA, 22 nt, Homo sapiens
uccacuuccuggguucaagcaa

SEQ ID NO: 3833 - RNA, 19 nt, Homo sapiens
ggagauggagguugcagug

SEQ ID NO: 3834 - RNA, 19 nt, Homo sapiens
cacugcaaccuccaucucc

SEQ ID NO: 3835 - RNA, 21 nt, Homo sapiens
accacugcacuccagccugag

SEQ ID NO: 3836 - RNA, 21 nt, Homo sapiens
cucaggcuggagugcaguggu

SEQ ID NO: 3837 - RNA, 22 nt, Homo sapiens
ggugguugaggcugcaguaagu

SEQ ID NO: 3838 - RNA, 22 nt, Homo sapiens
acuuacugcagccucaaccacc

SEQ ID NO: 3839 - RNA, 17 nt, Homo sapiens
ucgccuccuccucuccc

SEQ ID NO: 3840 - RNA, 17 nt, Homo sapiens
gggagaggaggaggcga

SEQ ID NO: 3841 - RNA, 22 nt, Homo sapiens
ucuauacagacccuggcuuuuc

SEQ ID NO: 3842 - RNA, 22 nt, Homo sapiens
gaaaagccagggucuguauaga

SEQ ID NO: 3843 - RNA, 22 nt, Homo sapiens
ucugggcaacaaagugagaccu

SEQ ID NO: 3844 - RNA, 22 nt, Homo sapiens
aggucucacuuuguugcccaga

SEQ ID NO: 3845 - RNA, 21 nt, Homo sapiens
gaucucacuuuguugcccagg

SEQ ID NO: 3846 - RNA, 21 nt, Homo sapiens
ccugggcaacaaagugagauc

SEQ ID NO: 3847 - RNA, 20 nt, Homo sapiens
ucgcgccccggcucccguuc

SEQ ID NO: 3848 - RNA, 20 nt, Homo sapiens
gaacgggagccggggcgcga

SEQ ID NO: 3849 - RNA, 25 nt, Homo sapiens
ugggaacggguuccggcagacgcug

SEQ ID NO: 3850 - RNA, 25 nt, Homo sapiens
cagcgucugccggaacccguuccca

SEQ ID NO: 3851 - RNA, 21 nt, Homo sapiens
uuaggccgcagaucuggguga

SEQ ID NO: 3852 - RNA, 21 nt, Homo sapiens
ucacccagaucugcggccuaa

SEQ ID NO: 3853 - RNA, 22 nt, Homo sapiens
aauaggccacggaucugggcaa

SEQ ID NO: 3854 - RNA, 22 nt, Homo sapiens
uugcccagauccguggccuauu

SEQ ID NO: 3855 - RNA, 21 nt, Homo sapiens
cacccagaucugcggccuaau

SEQ ID NO: 3856 - RNA, 21 nt, Homo sapiens
auuaggccgcagaucugggug

SEQ ID NO: 3857 - RNA, 22 nt, Homo sapiens
uuagggcccuggcuccaucucc

SEQ ID NO: 3858 - RNA, 22 nt, Homo sapiens
ggagauggagccagggcccuaa

SEQ ID NO: 3859 - RNA, 22 nt, Homo sapiens
uucauucggcuguccagaugua

SEQ ID NO: 3860 - RNA, 22 nt, Homo sapiens
uacaucuggacagccgaaugaa

SEQ ID NO: 3861 - RNA, 24 nt, Homo sapiens
uugcagcugccugggagugacuuc

SEQ ID NO: 3862 - RNA, 24 nt, Homo sapiens
gaagucacucccaggcagcugcaa

SEQ ID NO: 3863 - RNA, 21 nt, Homo sapiens
uugggacauacuuaugcuaaa

SEQ ID NO: 3864 - RNA, 21 nt, Homo sapiens
uuuagcauaaguaugucccaa

SEQ ID NO: 3865 - RNA, 22 nt, Homo sapiens
ucucacuguagccucgaacccc

SEQ ID NO: 3866 - RNA, 22 nt, Homo sapiens
gggguucgaggcuacagugaga

SEQ ID NO: 3867 - RNA, 22 nt, Homo sapiens
uuugaggcuacagugagaugug

SEQ ID NO: 3868 - RNA, 22 nt, Homo sapiens
cacaucucacuguagccucaaa

SEQ ID NO: 3869 - RNA, 18 nt, Homo sapiens
cagggaggugaaugugau

SEQ ID NO: 3870 - RNA, 18 nt, Homo sapiens
aucacauucaccucccug

SEQ ID NO: 3871 - RNA, 19 nt, Homo sapiens
gaugaugcugcugaugcug

SEQ ID NO: 3872 - RNA, 19 nt, Homo sapiens
cagcaucagcagcaucauc

SEQ ID NO: 3873 - RNA, 24 nt, Homo sapiens
ccagacagaauucuaugcacuuuc

SEQ ID NO: 3874 - RNA, 24 nt, Homo sapiens
gaaagugcauagaauucugucugg

SEQ ID NO: 3875 - RNA, 22 nt, Homo sapiens
cuccuggggcccgcacucucgc

SEQ ID NO: 3876 - RNA, 22 nt, Homo sapiens
gcgagagugcgggccccaggag

SEQ ID NO: 3877 - RNA, 21 nt, Homo sapiens
cuccguuugccuguuucgcug

SEQ ID NO: 3878 - RNA, 21 nt, Homo sapiens
cagcgaaacaggcaaacggag

SEQ ID NO: 3879 - RNA, 22 nt, Homo sapiens
cucggcgcggggcgcgggcucc

SEQ ID NO: 3880 - RNA, 22 nt, Homo sapiens
ggagcccgcgccccgcgccgag

SEQ ID NO: 3881 - RNA, 21 nt, Homo sapiens
gcccuccgcccgugcaccccg

SEQ ID NO: 3882 - RNA, 21 nt, Homo sapiens
cggggugcacgggcggagggc

SEQ ID NO: 3883 - RNA, 22 nt, Homo sapiens
gcccgcguguggagccaggugu

SEQ ID NO: 3884 - RNA, 22 nt, Homo sapiens
acaccuggcuccacacgcgggc

SEQ ID NO: 3885 - RNA, 22 nt, Homo sapiens
aaaaccgucuaguuacaguugu

SEQ ID NO: 3886 - RNA, 22 nt, Homo sapiens
acaacuguaacuagacgguuuu

SEQ ID NO: 3887 - RNA, 18 nt, Homo sapiens
uccagugcccuccucucc

SEQ ID NO: 3888 - RNA, 18 nt, Homo sapiens
ggagaggagggcacugga

SEQ ID NO: 3889 - RNA, 18 nt, Homo sapiens
ugaggcaguagauugaau

SEQ ID NO: 3890 - RNA, 18 nt, Homo sapiens
auucaaucuacugccuca

SEQ ID NO: 3891 - RNA, 22 nt, Homo sapiens
aggggcuggcuuuccucugguc

SEQ ID NO: 3892 - RNA, 22 nt, Homo sapiens
gaccagaggaaagccagccccu

SEQ ID NO: 3893 - RNA, 22 nt, Homo sapiens
uggagagaaaggcaguuccuga

SEQ ID NO: 3894 - RNA, 22 nt, Homo sapiens
ucaggaacugccuuucucucca

SEQ ID NO: 3895 - RNA, 22 nt, Homo sapiens
ucgugucuuguguugcagccgg

SEQ ID NO: 3896 - RNA, 22 nt, Homo sapiens
ccggcugcaacacaagacacga

SEQ ID NO: 3897 - RNA, 22 nt, Homo sapiens
ggcuacaacacaggacccgggc

SEQ ID NO: 3898 - RNA, 22 nt, Homo sapiens
gcccggguccuguguuguagcc

SEQ ID NO: 3899 - RNA, 21 nt, Homo sapiens
cggcggggacggcgauugguc

SEQ ID NO: 3900 - RNA, 21 nt, Homo sapiens
gaccaaucgccguccccgccg

SEQ ID NO: 3901 - RNA, 22 nt, Homo sapiens
cgcaggggccgggugcucaccg

SEQ ID NO: 3902 - RNA, 22 nt, Homo sapiens
cggugagcacccggccccugcg

SEQ ID NO: 3903 - RNA, 21 nt, Homo sapiens
ugagugccggugccugcccug

SEQ ID NO: 3904 - RNA, 21 nt, Homo sapiens
cagggcaggcaccggcacuca

SEQ ID NO: 3905 - RNA, 22 nt, Homo sapiens
gcugcgcuuggauuucgucccc

SEQ ID NO: 3906 - RNA, 22 nt, Homo sapiens
ggggacgaaauccaagcgcagc

SEQ ID NO: 3907 - RNA, 23 nt, Homo sapiens
caacggaaucccaaaagcagcug

SEQ ID NO: 3908 - RNA, 23 nt, Homo sapiens
cagcugcuuuugggauuccguug

SEQ ID NO: 3909 - RNA, 22 nt, Homo sapiens
ucaggccaggcacaguggcuca

SEQ ID NO: 3910 - RNA, 22 nt, Homo sapiens
ugagccacugugccuggccuga

SEQ ID NO: 3911 - RNA, 19 nt, Homo sapiens
accgugcaaagguagcaua

SEQ ID NO: 3912 - RNA, 19 nt, Homo sapiens
uaugcuaccuuugcacggu

SEQ ID NO: 3913 - RNA, 20 nt, Homo sapiens
ccuccugcccuccuugcugu

SEQ ID NO: 3914 - RNA, 20 nt, Homo sapiens
acagcaaggagggcaggagg

SEQ ID NO: 3915 - RNA, 20 nt, Homo sapiens
uguuuugauaacaguaaugu

SEQ ID NO: 3916 - RNA, 20 nt, Homo sapiens
acauuacuguuaucaaaaca

SEQ ID NO: 3917 - RNA, 23 nt, Homo sapiens
guguuaauuaaaccucuauuuac

SEQ ID NO: 3918 - RNA, 23 nt, Homo sapiens
guaaauagagguuuaauuaacac

SEQ ID NO: 3919 - RNA, 23 nt, Homo sapiens
cuguaauauaaauuuaauuuauu

SEQ ID NO: 3920 - RNA, 23 nt, Homo sapiens
aauaaauuaaauuuauauuacag

SEQ ID NO: 3921 - RNA, 22 nt, Homo sapiens
uuggggaaacggccgcugagug

SEQ ID NO: 3922 - RNA, 22 nt, Homo sapiens
cacucagcggccguuuccccaa

SEQ ID NO: 3923 - RNA, 21 nt, Homo sapiens
ccucccaugccaagaacuccc

SEQ ID NO: 3924 - RNA, 21 nt, Homo sapiens
gggaguucuuggcaugggagg

SEQ ID NO: 3925 - RNA, 21 nt, Homo sapiens
gguucuuagcauaggaggucu

SEQ ID NO: 3926 - RNA, 21 nt, Homo sapiens
agaccuccuaugcuaagaacc

SEQ ID NO: 3927 - RNA, 21 nt, Homo sapiens
uguucucuuugccaaggacag

SEQ ID NO: 3928 - RNA, 21 nt, Homo sapiens
cuguccuuggcaaagagaaca

SEQ ID NO: 3929 - RNA, 22 nt, Homo sapiens
aaaucucugcaggcaaauguga

SEQ ID NO: 3930 - RNA, 22 nt, Homo sapiens
ucacauuugccugcagagauuu

SEQ ID NO: 3931 - RNA, 22 nt, Homo sapiens
caugguucugucaagcaccgcg

SEQ ID NO: 3932 - RNA, 22 nt, Homo sapiens
cgcggugcuugacagaaccaug

SEQ ID NO: 3933 - RNA, 21 nt, Homo sapiens
uugugcuugaucuaaccaugu

SEQ ID NO: 3934 - RNA, 21 nt, Homo sapiens
acaugguuagaucaagcacaa

SEQ ID NO: 3935 - RNA, 22 nt, Homo sapiens
ucugcaagugucagaggcgagg

SEQ ID NO: 3936 - RNA, 22 nt, Homo sapiens
ccucgccucugacacuugcaga

SEQ ID NO: 3937 - RNA, 22 nt, Homo sapiens
gagagcaguguguguugccugg

SEQ ID NO: 3938 - RNA, 22 nt, Homo sapiens
ccaggcaacacacacugcucuc

SEQ ID NO: 3939 - RNA, 22 nt, Homo sapiens
aucacauugccagugauuaccc

SEQ ID NO: 3940 - RNA, 22 nt, Homo sapiens
ggguaaucacuggcaaugugau

SEQ ID NO: 3941 - RNA, 22 nt, Homo sapiens
agcagaggcagagaggcucagg

SEQ ID NO: 3942 - RNA, 22 nt, Homo sapiens
ccugagccucucugccucugcu

SEQ ID NO: 3943 - RNA, 23 nt, Homo sapiens
ugaggcucuguuagccuuggcuc

SEQ ID NO: 3944 - RNA, 23 nt, Homo sapiens
gagccaaggcuaacagagccuca

SEQ ID NO: 3945 - RNA, 22 nt, Homo sapiens
uaucauggaguugguaaagcac

SEQ ID NO: 3946 - RNA, 22 nt, Homo sapiens
gugcuuuaccaacuccaugaua

SEQ ID NO: 3947 - RNA, 22 nt, Homo sapiens
guuuuaccaccuccaggagacu

SEQ ID NO: 3948 - RNA, 22 nt, Homo sapiens
agucuccuggaggugguaaaac

SEQ ID NO: 3949 - RNA, 22 nt, Homo sapiens
cgccucuucagcgcugucuucc

SEQ ID NO: 3950 - RNA, 22 nt, Homo sapiens
ggaagacagcgcugaagaggcg

SEQ ID NO: 3951 - RNA, 23 nt, Homo sapiens
caggcagugacuguucagacguc

SEQ ID NO: 3952 - RNA, 23 nt, Homo sapiens
gacgucugaacagucacugccug

SEQ ID NO: 3953 - RNA, 23 nt, Homo sapiens
agaauugcguuuggacaaucagu

SEQ ID NO: 3954 - RNA, 23 nt, Homo sapiens
acugauuguccaaacgcaauucu

SEQ ID NO: 3955 - RNA, 22 nt, Homo sapiens
agauguccagccacaauucucg

SEQ ID NO: 3956 - RNA, 22 nt, Homo sapiens
cgagaauuguggcuggacaucu

SEQ ID NO: 3957 - RNA, 24 nt, Homo sapiens
agcagaagcagggagguucuccca

SEQ ID NO: 3958 - RNA, 24 nt, Homo sapiens
ugggagaaccucccugcuucugcu

SEQ ID NO: 3959 - RNA, 22 nt, Homo sapiens
uaugugggaugguaaaccgcuu

SEQ ID NO: 3960 - RNA, 22 nt, Homo sapiens
aagcgguuuaccaucccacaua

SEQ ID NO: 3961 - RNA, 22 nt, Homo sapiens
ugguuuaccgucccacauacau

SEQ ID NO: 3962 - RNA, 22 nt, Homo sapiens
auguaugugggacgguaaacca

SEQ ID NO: 3963 - RNA, 23 nt, Homo sapiens
cagugcaaugauauugucaaagc

SEQ ID NO: 3964 - RNA, 23 nt, Homo sapiens
gcuuugacaauaucauugcacug

SEQ ID NO: 3965 - RNA, 17 nt, Homo sapiens
uaauugcuuccauguuu

SEQ ID NO: 3966 - RNA, 17 nt, Homo sapiens
aaacauggaagcaauua

SEQ ID NO: 3967 - RNA, 23 nt, Homo sapiens
uugccacacugcaacaccuuaca

SEQ ID NO: 3968 - RNA, 23 nt, Homo sapiens
uguaagguguugcaguguggcaa

SEQ ID NO: 3969 - RNA, 21 nt, Homo sapiens
ucuggcuguuguggugugcaa

SEQ ID NO: 3970 - RNA, 21 nt, Homo sapiens
uugcacaccacaacagccaga

SEQ ID NO: 3971 - RNA, 22 nt, Homo sapiens
gauaucagcucaguaggcaccg

SEQ ID NO: 3972 - RNA, 22 nt, Homo sapiens
cggugccuacugagcugauauc

SEQ ID NO: 3973 - RNA, 21 nt, Homo sapiens
guuccugcugaacugagccag

SEQ ID NO: 3974 - RNA, 21 nt, Homo sapiens
cuggcucaguucagcaggaac

SEQ ID NO: 3975 - RNA, 20 nt, Homo sapiens
auauggguuuacuaguuggu

SEQ ID NO: 3976 - RNA, 20 nt, Homo sapiens
accaacuaguaaacccauau

SEQ ID NO: 3977 - RNA, 22 nt, Homo sapiens
ugcuaugccaacauauugccau

SEQ ID NO: 3978 - RNA, 22 nt, Homo sapiens
auggcaauauguuggcauagca

SEQ ID NO: 3979 - RNA, 21 nt, Homo sapiens
aggcaagaugcuggcauagcu

SEQ ID NO: 3980 - RNA, 21 nt, Homo sapiens
agcuaugccagcaucuugccu

SEQ ID NO: 3981 - RNA, 18 nt, Homo sapiens
cggggcggcaggggccuc

SEQ ID NO: 3982 - RNA, 18 nt, Homo sapiens
gaggccccugccgccccg

SEQ ID NO: 3983 - RNA, 19 nt, Homo sapiens
aaaagcuggguugagagga

SEQ ID NO: 3984 - RNA, 19 nt, Homo sapiens
uccucucaacccagcuuuu

SEQ ID NO: 3985 - RNA, 22 nt, Homo sapiens
cccaauacacggucgaccucuu

SEQ ID NO: 3986 - RNA, 22 nt, Homo sapiens
aagaggucgaccguguauuggg

SEQ ID NO: 3987 - RNA, 23 nt, Homo sapiens
agguuguccguggugaguucgca

SEQ ID NO: 3988 - RNA, 23 nt, Homo sapiens
ugcgaacucaccacggacaaccu

SEQ ID NO: 3989 - RNA, 23 nt, Homo sapiens
gcaaagcacacggccugcagaga

SEQ ID NO: 3990 - RNA, 23 nt, Homo sapiens
ucucugcaggccgugugcuuugc

SEQ ID NO: 3991 - RNA, 22 nt, Homo sapiens
ucucugggccugugucuuaggc

SEQ ID NO: 3992 - RNA, 22 nt, Homo sapiens
gccuaagacacaggcccagaga

SEQ ID NO: 3993 - RNA, 21 nt, Homo sapiens
gccccugggccuauccuagaa

SEQ ID NO: 3994 - RNA, 21 nt, Homo sapiens
uucuaggauaggcccaggggc

SEQ ID NO: 3995 - RNA, 22 nt, Homo sapiens
uccgucucaguuacuuuauagc

SEQ ID NO: 3996 - RNA, 22 nt, Homo sapiens
gcuauaaaguaacugagacgga

SEQ ID NO: 3997 - RNA, 22 nt, Homo sapiens
aacacaccuauucaaggauuca

SEQ ID NO: 3998 - RNA, 22 nt, Homo sapiens
ugaauccuugaauagguguguu

SEQ ID NO: 3999 - RNA, 24 nt, Homo sapiens
aauccuuggaaccuaggugugagu

SEQ ID NO: 4000 - RNA, 24 nt, Homo sapiens
acucacaccuagguuccaaggauu

SEQ ID NO: 4001 - RNA, 22 nt, Homo sapiens
uaaugccccuaaaaauccuuau

SEQ ID NO: 4002 - RNA, 22 nt, Homo sapiens
auaaggauuuuuaggggcauua

SEQ ID NO: 4003 - RNA, 23 nt, Homo sapiens
agggacuuuugggggcagaugug

SEQ ID NO: 4004 - RNA, 23 nt, Homo sapiens
cacaucugcccccaaaagucccu

SEQ ID NO: 4005 - RNA, 22 nt, Homo sapiens
uaaugccccuaaaaauccuuau

SEQ ID NO: 4006 - RNA, 22 nt, Homo sapiens
auaaggauuuuuaggggcauua

SEQ ID NO: 4007 - RNA, 22 nt, Homo sapiens
agggacuuucaggggcagcugu

SEQ ID NO: 4008 - RNA, 22 nt, Homo sapiens
acagcugccccugaaagucccu

SEQ ID NO: 4009 - RNA, 24 nt, Homo sapiens
gaaaaugaugaguagugacugaug

SEQ ID NO: 4010 - RNA, 24 nt, Homo sapiens
caucagucacuacucaucauuuuc

SEQ ID NO: 4011 - RNA, 23 nt, Homo sapiens
ugagcaccacacaggccgggcgc

SEQ ID NO: 4012 - RNA, 23 nt, Homo sapiens
gcgcccggccuguguggugcuca

SEQ ID NO: 4013 - RNA, 21 nt, Homo sapiens
gcuggucugcguggugcucgg

SEQ ID NO: 4014 - RNA, 21 nt, Homo sapiens
ccgagcaccacgcagaccagc

SEQ ID NO: 4015 - RNA, 22 nt, Homo sapiens
gccugcugggguggaaccuggu

SEQ ID NO: 4016 - RNA, 22 nt, Homo sapiens
accagguuccaccccagcaggc

SEQ ID NO: 4017 - RNA, 23 nt, Homo sapiens
gaagugcuucgauuuuggggugu

SEQ ID NO: 4018 - RNA, 23 nt, Homo sapiens
acaccccaaaaucgaagcacuuc

SEQ ID NO: 4019 - RNA, 22 nt, Homo sapiens
acucaaaaugggggcgcuuucc

SEQ ID NO: 4020 - RNA, 22 nt, Homo sapiens
ggaaagcgcccccauuuugagu

SEQ ID NO: 4021 - RNA, 22 nt, Homo sapiens
uauguaacaugguccacuaacu

SEQ ID NO: 4022 - RNA, 22 nt, Homo sapiens
aguuaguggaccauguuacaua

SEQ ID NO: 4023 - RNA, 21 nt, Homo sapiens
ugguagacuauggaacguagg

SEQ ID NO: 4024 - RNA, 21 nt, Homo sapiens
ccuacguuccauagucuacca

SEQ ID NO: 4025 - RNA, 22 nt, Homo sapiens
uguagauacgagcaccagccac

SEQ ID NO: 4026 - RNA, 22 nt, Homo sapiens
guggcuggugcucguaucuaca

SEQ ID NO: 4027 - RNA, 23 nt, Homo sapiens
acaggcggcuguagcaauggggg

SEQ ID NO: 4028 - RNA, 23 nt, Homo sapiens
cccccauugcuacagccgccugu

SEQ ID NO: 4029 - RNA, 22 nt, Homo sapiens
aauucccuuguagauaacccgg

SEQ ID NO: 4030 - RNA, 22 nt, Homo sapiens
ccggguuaucuacaagggaauu

SEQ ID NO: 4031 - RNA, 22 nt, Homo sapiens
uacgcgcagaccacaggauguc

SEQ ID NO: 4032 - RNA, 22 nt, Homo sapiens
gacauccuguggucugcgcgua

SEQ ID NO: 4033 - RNA, 22 nt, Homo sapiens
uuacacacaacugaggaucaua

SEQ ID NO: 4034 - RNA, 22 nt, Homo sapiens
uaugauccucaguuguguguaa

SEQ ID NO: 4035 - RNA, 23 nt, Homo sapiens
uagcccccaggcuucacuuggcg

SEQ ID NO: 4036 - RNA, 23 nt, Homo sapiens
cgccaagugaagccugggggcua

SEQ ID NO: 4037 - RNA, 23 nt, Homo sapiens
agggcauaggagaggguugauau

SEQ ID NO: 4038 - RNA, 23 nt, Homo sapiens
auaucaacccucuccuaugcccu

SEQ ID NO: 4039 - RNA, 22 nt, Homo sapiens
gaauguugcucggugaaccccu

SEQ ID NO: 4040 - RNA, 22 nt, Homo sapiens
agggguucaccgagcaacauuc

SEQ ID NO: 4041 - RNA, 23 nt, Homo sapiens
agguuacccgagcaacuuugcau

SEQ ID NO: 4042 - RNA, 23 nt, Homo sapiens
augcaaaguugcucggguaaccu

SEQ ID NO: 4043 - RNA, 22 nt, Homo sapiens
uauguaacacgguccacuaacc

SEQ ID NO: 4044 - RNA, 22 nt, Homo sapiens
gguuaguggaccguguuacaua

SEQ ID NO: 4045 - RNA, 21 nt, Homo sapiens
uaguagaccguauagcguacg

SEQ ID NO: 4046 - RNA, 21 nt, Homo sapiens
cguacgcuauacggucuacua

SEQ ID NO: 4047 - RNA, 23 nt, Homo sapiens
acuucaccugguccacuagccgu

SEQ ID NO: 4048 - RNA, 23 nt, Homo sapiens
acggcuaguggaccaggugaagu

SEQ ID NO: 4049 - RNA, 18 nt, Homo sapiens
guguucucugauggacag

SEQ ID NO: 4050 - RNA, 18 nt, Homo sapiens
cuguccaucagagaacac

SEQ ID NO: 4051 - RNA, 22 nt, Homo sapiens
caggucgucuugcagggcuucu

SEQ ID NO: 4052 - RNA, 22 nt, Homo sapiens
agaagcccugcaagacgaccug

SEQ ID NO: 4053 - RNA, 21 nt, Homo sapiens
ugucuugcaggccgucaugca

SEQ ID NO: 4054 - RNA, 21 nt, Homo sapiens
ugcaugacggccugcaagaca

SEQ ID NO: 4055 - RNA, 22 nt, Homo sapiens
aucaugaugggcuccucggugu

SEQ ID NO: 4056 - RNA, 22 nt, Homo sapiens
acaccgaggagcccaucaugau

SEQ ID NO: 4057 - RNA, 23 nt, Homo sapiens
uugcuaguugcacuccucucugu

SEQ ID NO: 4058 - RNA, 23 nt, Homo sapiens
acagagaggagugcaacuagcaa

SEQ ID NO: 4059 - RNA, 25 nt, Homo sapiens
uaggcaguguauugcuagcggcugu

SEQ ID NO: 4060 - RNA, 25 nt, Homo sapiens
acagccgcuagcaauacacugccua

SEQ ID NO: 4061 - RNA, 22 nt, Homo sapiens
auuggggacauuuugcauucau

SEQ ID NO: 4062 - RNA, 22 nt, Homo sapiens
augaaugcaaaauguccccaau

SEQ ID NO: 4063 - RNA, 22 nt, Homo sapiens
uuuugcgauguguuccuaauau

SEQ ID NO: 4064 - RNA, 22 nt, Homo sapiens
auauuaggaacacaucgcaaaa

SEQ ID NO: 4065 - RNA, 22 nt, Homo sapiens
uugggaucauuuugcauccaua

SEQ ID NO: 4066 - RNA, 22 nt, Homo sapiens
uauggaugcaaaaugaucccaa

SEQ ID NO: 4067 - RNA, 22 nt, Homo sapiens
uuuugcaauauguuccugaaua

SEQ ID NO: 4068 - RNA, 22 nt, Homo sapiens
uauucaggaacauauugcaaaa

SEQ ID NO: 4069 - RNA, 21 nt, Homo sapiens
gcaguccaugggcauauacac

SEQ ID NO: 4070 - RNA, 21 nt, Homo sapiens
guguauaugcccauggacugc

SEQ ID NO: 4071 - RNA, 22 nt, Homo sapiens
uaugugccuuuggacuacaucg

SEQ ID NO: 4072 - RNA, 22 nt, Homo sapiens
cgauguaguccaaaggcacaua

SEQ ID NO: 4073 - RNA, 23 nt, Homo sapiens
auacacauacacgcaacacacau

SEQ ID NO: 4074 - RNA, 23 nt, Homo sapiens
auguguguugcguguauguguau

SEQ ID NO: 4075 - RNA, 23 nt, Homo sapiens
uugcaugucagauuguaauuccc

SEQ ID NO: 4076 - RNA, 23 nt, Homo sapiens
gggaauuacaaucugacaugcaa

SEQ ID NO: 4077 - RNA, 21 nt, Homo sapiens
ucacuccucuccucccgucuu

SEQ ID NO: 4078 - RNA, 21 nt, Homo sapiens
aagacgggaggagaggaguga

SEQ ID NO: 4079 - RNA, 22 nt, Homo sapiens
ucaggcucaguccccucccgau

SEQ ID NO: 4080 - RNA, 22 nt, Homo sapiens
aucgggaggggacugagccuga

SEQ ID NO: 4081 - RNA, 22 nt, Homo sapiens
gucauacacggcucuccucucu

SEQ ID NO: 4082 - RNA, 22 nt, Homo sapiens
agagaggagagccguguaugac

SEQ ID NO: 4083 - RNA, 22 nt, Homo sapiens
agaggcuggccgugaugaauuc

SEQ ID NO: 4084 - RNA, 22 nt, Homo sapiens
gaauucaucacggccagccucu

SEQ ID NO: 4085 - RNA, 22 nt, Homo sapiens
aaucauacagggacauccaguu

SEQ ID NO: 4086 - RNA, 22 nt, Homo sapiens
aacuggaugucccuguaugauu

SEQ ID NO: 4087 - RNA, 22 nt, Homo sapiens
aaucguacagggucauccacuu

SEQ ID NO: 4088 - RNA, 22 nt, Homo sapiens
aaguggaugacccuguacgauu

SEQ ID NO: 4089 - RNA, 21 nt, Homo sapiens
uugaaaggcuauuucuugguc

SEQ ID NO: 4090 - RNA, 21 nt, Homo sapiens
gaccaagaaauagccuuucaa

SEQ ID NO: 4091 - RNA, 21 nt, Homo sapiens
cccagauaauggcacucucaa

SEQ ID NO: 4092 - RNA, 21 nt, Homo sapiens
uugagagugccauuaucuggg

SEQ ID NO: 4093 - RNA, 22 nt, Homo sapiens
caaccuggaggacuccaugcug

SEQ ID NO: 4094 - RNA, 22 nt, Homo sapiens
cagcauggaguccuccagguug

SEQ ID NO: 4095 - RNA, 20 nt, Homo sapiens
ccauggaucuccaggugggu

SEQ ID NO: 4096 - RNA, 20 nt, Homo sapiens
acccaccuggagauccaugg

SEQ ID NO: 4097 - RNA, 22 nt, Homo sapiens
cuuaugcaagauucccuucuac

SEQ ID NO: 4098 - RNA, 22 nt, Homo sapiens
guagaagggaaucuugcauaag

SEQ ID NO: 4099 - RNA, 22 nt, Homo sapiens
aguggggaacccuuccaugagg

SEQ ID NO: 4100 - RNA, 22 nt, Homo sapiens
ccucauggaaggguuccccacu

SEQ ID NO: 4101 - RNA, 23 nt, Homo sapiens
aggaccugcgggacaagauucuu

SEQ ID NO: 4102 - RNA, 23 nt, Homo sapiens
aagaaucuugucccgcagguccu

SEQ ID NO: 4103 - RNA, 22 nt, Homo sapiens
caaaccacacugugguguuaga

SEQ ID NO: 4104 - RNA, 22 nt, Homo sapiens
ucuaacaccacagugugguuug

SEQ ID NO: 4105 - RNA, 21 nt, Homo sapiens
cagcagcacacugugguuugu

SEQ ID NO: 4106 - RNA, 21 nt, Homo sapiens
acaaaccacagugugcugcug

SEQ ID NO: 4107 - RNA, 23 nt, Homo sapiens
uuucaagccagggggcguuuuuc

SEQ ID NO: 4108 - RNA, 23 nt, Homo sapiens
gaaaaacgcccccuggcuugaaa

SEQ ID NO: 4109 - RNA, 20 nt, Homo sapiens
ucacuaccugacaauacagu

SEQ ID NO: 4110 - RNA, 20 nt, Homo sapiens
acuguauugucagguaguga

SEQ ID NO: 4111 - RNA, 21 nt, Homo sapiens
ugcuguauugucagguaguga

SEQ ID NO: 4112 - RNA, 21 nt, Homo sapiens
ucacuaccugacaauacagca

SEQ ID NO: 4113 - RNA, 22 nt, Homo sapiens
uucugccucuguccagguccuu

SEQ ID NO: 4114 - RNA, 22 nt, Homo sapiens
aaggaccuggacagaggcagaa

SEQ ID NO: 4115 - RNA, 24 nt, Homo sapiens
agggcuggacucagcggcggagcu

SEQ ID NO: 4116 - RNA, 24 nt, Homo sapiens
agcuccgccgcugaguccagcccu

SEQ ID NO: 4117 - RNA, 21 nt, Homo sapiens
ugacugccucacugaccacuu

SEQ ID NO: 4118 - RNA, 21 nt, Homo sapiens
aaguggucagugaggcaguca

SEQ ID NO: 4119 - RNA, 24 nt, Homo sapiens
aauuugguuucugaggcacuuagu

SEQ ID NO: 4120 - RNA, 24 nt, Homo sapiens
acuaagugccucagaaaccaaauu

SEQ ID NO: 4121 - RNA, 21 nt, Homo sapiens
uacuuuucuagguuguugggg

SEQ ID NO: 4122 - RNA, 21 nt, Homo sapiens
ccccaacaaccuagaaaagua

SEQ ID NO: 4123 - RNA, 23 nt, Homo sapiens
ucacaacaaccuugcaggguaga

SEQ ID NO: 4124 - RNA, 23 nt, Homo sapiens
ucuacccugcaagguuguuguga

SEQ ID NO: 4125 - RNA, 22 nt, Homo sapiens
cuuggauuuuccugggccucag

SEQ ID NO: 4126 - RNA, 22 nt, Homo sapiens
cugaggcccaggaaaauccaag

SEQ ID NO: 4127 - RNA, 22 nt, Homo sapiens
ugaggacagggcaaauucacga

SEQ ID NO: 4128 - RNA, 22 nt, Homo sapiens
ucgugaauuugcccuguccuca

SEQ ID NO: 4129 - RNA, 22 nt, Homo sapiens
aucauaugaaccaaacucuaau

SEQ ID NO: 4130 - RNA, 22 nt, Homo sapiens
auuagaguuugguucauaugau

SEQ ID NO: 4131 - RNA, 22 nt, Homo sapiens
uagagucuggcugauaugguuu

SEQ ID NO: 4132 - RNA, 22 nt, Homo sapiens
aaaccauaucagccagacucua

SEQ ID NO: 4133 - RNA, 21 nt, Homo sapiens
ccugugcucccagggccucgc

SEQ ID NO: 4134 - RNA, 21 nt, Homo sapiens
gcgaggcccugggagcacagg

SEQ ID NO: 4135 - RNA, 22 nt, Homo sapiens
ugaggcccuuggggcacagugg

SEQ ID NO: 4136 - RNA, 22 nt, Homo sapiens
ccacugugccccaagggccuca

SEQ ID NO: 4137 - RNA, 22 nt, Homo sapiens
uccuaaaucugaaaguccaaaa

SEQ ID NO: 4138 - RNA, 22 nt, Homo sapiens
uuuuggacuuucagauuuagga

SEQ ID NO: 4139 - RNA, 24 nt, Homo sapiens
uuggacuuuuucagauuuggggau

SEQ ID NO: 4140 - RNA, 24 nt, Homo sapiens
auccccaaaucugaaaaaguccaa

SEQ ID NO: 4141 - RNA, 22 nt, Homo sapiens
augcaccugggcaaggauucug

SEQ ID NO: 4142 - RNA, 22 nt, Homo sapiens
cagaauccuugcccaggugcau

SEQ ID NO: 4143 - RNA, 23 nt, Homo sapiens
uaauccuugcuaccugggugaga

SEQ ID NO: 4144 - RNA, 23 nt, Homo sapiens
ucucacccagguagcaaggauua

SEQ ID NO: 4145 - RNA, 22 nt, Homo sapiens
uuuugugucucccauuccccag

SEQ ID NO: 4146 - RNA, 22 nt, Homo sapiens
cuggggaaugggagacacaaaa

SEQ ID NO: 4147 - RNA, 22 nt, Homo sapiens
agggggauggcagagcaaaauu

SEQ ID NO: 4148 - RNA, 22 nt, Homo sapiens
aauuuugcucugccaucccccu

SEQ ID NO: 4149 - RNA, 22 nt, Homo sapiens
gugcauggcuguauauauaaca

SEQ ID NO: 4150 - RNA, 22 nt, Homo sapiens
uguuauauauacagccaugcac

SEQ ID NO: 4151 - RNA, 21 nt, Homo sapiens
uauauauacagccaugcacuc

SEQ ID NO: 4152 - RNA, 21 nt, Homo sapiens
gagugcauggcuguauauaua

SEQ ID NO: 4153 - RNA, 22 nt, Homo sapiens
aaugcacccgggcaaggauucu

SEQ ID NO: 4154 - RNA, 22 nt, Homo sapiens
agaauccuugcccgggugcauu

SEQ ID NO: 4155 - RNA, 22 nt, Homo sapiens
aauccuuugucccugggugaga

SEQ ID NO: 4156 - RNA, 22 nt, Homo sapiens
ucucacccagggacaaaggauu

SEQ ID NO: 4157 - RNA, 22 nt, Homo sapiens
aaugcaccugggcaaggauuca

SEQ ID NO: 4158 - RNA, 22 nt, Homo sapiens
ugaauccuugcccaggugcauu

SEQ ID NO: 4159 - RNA, 21 nt, Homo sapiens
auccuugcuaucugggugcua

SEQ ID NO: 4160 - RNA, 21 nt, Homo sapiens
uagcacccagauagcaaggau

SEQ ID NO: 4161 - RNA, 22 nt, Homo sapiens
agacccuggucugcacucuauc

SEQ ID NO: 4162 - RNA, 22 nt, Homo sapiens
gauagagugcagaccagggucu

SEQ ID NO: 4163 - RNA, 21 nt, Homo sapiens
uugcagcugcgguuguaaggu

SEQ ID NO: 4164 - RNA, 21 nt, Homo sapiens
accuuacaaccgcagcugcaa

SEQ ID NO: 4165 - RNA, 22 nt, Homo sapiens
cgucaacacuugcugguuuccu

SEQ ID NO: 4166 - RNA, 22 nt, Homo sapiens
aggaaaccagcaaguguugacg

SEQ ID NO: 4167 - RNA, 22 nt, Homo sapiens
gggagccaggaaguauugaugu

SEQ ID NO: 4168 - RNA, 22 nt, Homo sapiens
acaucaauacuuccuggcuccc

SEQ ID NO: 4169 - RNA, 21 nt, Homo sapiens
uaaggcacccuucugaguaga

SEQ ID NO: 4170 - RNA, 21 nt, Homo sapiens
ucuacucagaagggugccuua

SEQ ID NO: 4171 - RNA, 22 nt, Homo sapiens
uauucaggaagguguuacuuaa

SEQ ID NO: 4172 - RNA, 22 nt, Homo sapiens
uuaaguaacaccuuccugaaua

SEQ ID NO: 4173 - RNA, 21 nt, Homo sapiens
uuuugcaccuuuuggagugaa

SEQ ID NO: 4174 - RNA, 21 nt, Homo sapiens
uucacuccaaaaggugcaaaa

SEQ ID NO: 4175 - RNA, 23 nt, Homo sapiens
ugauuguagccuuuuggaguaga

SEQ ID NO: 4176 - RNA, 23 nt, Homo sapiens
ucuacuccaaaaggcuacaauca

SEQ ID NO: 4177 - RNA, 23 nt, Homo sapiens
ggguuuguagcuuugcuggcaug

SEQ ID NO: 4178 - RNA, 23 nt, Homo sapiens
caugccagcaaagcuacaaaccc

SEQ ID NO: 4179 - RNA, 23 nt, Homo sapiens
cagggcucagggauuggauggag

SEQ ID NO: 4180 - RNA, 23 nt, Homo sapiens
cuccauccaaucccugagcccug

SEQ ID NO: 4181 - RNA, 23 nt, Homo sapiens
augcuacucggaaaucccacuga

SEQ ID NO: 4182 - RNA, 23 nt, Homo sapiens
ucagugggauuuccgaguagcau

SEQ ID NO: 4183 - RNA, 21 nt, Homo sapiens
gugggauuucugaguagcauc

SEQ ID NO: 4184 - RNA, 21 nt, Homo sapiens
gaugcuacucagaaaucccac

SEQ ID NO: 4185 - RNA, 23 nt, Homo sapiens
ccggggcagauugguguagggug

SEQ ID NO: 4186 - RNA, 23 nt, Homo sapiens
cacccuacaccaaucugccccgg

SEQ ID NO: 4187 - RNA, 23 nt, Homo sapiens
acggagacgacaagacugugcug

SEQ ID NO: 4188 - RNA, 23 nt, Homo sapiens
cagcacagucuugucgucuccgu

SEQ ID NO: 4189 - RNA, 22 nt, Homo sapiens
aauccacgcugagcuuggcauc

SEQ ID NO: 4190 - RNA, 22 nt, Homo sapiens
gaugccaagcucagcguggauu

SEQ ID NO: 4191 - RNA, 23 nt, Homo sapiens
aggaaaugaggcuggcuaggagc

SEQ ID NO: 4192 - RNA, 23 nt, Homo sapiens
gcuccuagccagccucauuuccu

SEQ ID NO: 4193 - RNA, 22 nt, Homo sapiens
ugauugguacgucuguggguag

SEQ ID NO: 4194 - RNA, 22 nt, Homo sapiens
cuacccacagacguaccaauca

SEQ ID NO: 4195 - RNA, 22 nt, Homo sapiens
aaucagugaaugccuugaaccu

SEQ ID NO: 4196 - RNA, 22 nt, Homo sapiens
agguucaaggcauucacugauu

SEQ ID NO: 4197 - RNA, 21 nt, Homo sapiens
uuacaggcgugaaccaccgcg

SEQ ID NO: 4198 - RNA, 21 nt, Homo sapiens
cgcggugguucacgccuguaa

SEQ ID NO: 4199 - RNA, 21 nt, Homo sapiens
uacugcagacaguggcaauca

SEQ ID NO: 4200 - RNA, 21 nt, Homo sapiens
ugauugccacugucugcagua

SEQ ID NO: 4201 - RNA, 21 nt, Homo sapiens
guuucaccauguuggucaggc

SEQ ID NO: 4202 - RNA, 21 nt, Homo sapiens
gccugaccaacauggugaaac

SEQ ID NO: 4203 - RNA, 23 nt, Homo sapiens
uaaauuucaccuuucugagaagg

SEQ ID NO: 4204 - RNA, 23 nt, Homo sapiens
ccuucucagaaaggugaaauuua

SEQ ID NO: 4205 - RNA, 22 nt, Homo sapiens
uucacaaggaggugucauuuau

SEQ ID NO: 4206 - RNA, 22 nt, Homo sapiens
auaaaugacaccuccuugugaa

SEQ ID NO: 4207 - RNA, 23 nt, Homo sapiens
uaaauuucaccuuucugagaaga

SEQ ID NO: 4208 - RNA, 23 nt, Homo sapiens
ucuucucagaaaggugaaauuua

SEQ ID NO: 4209 - RNA, 22 nt, Homo sapiens
uucucaaggaggugucguuuau

SEQ ID NO: 4210 - RNA, 22 nt, Homo sapiens
auaaacgacaccuccuugagaa

SEQ ID NO: 4211 - RNA, 21 nt, Homo sapiens
auugacacuucugugaguaga

SEQ ID NO: 4212 - RNA, 21 nt, Homo sapiens
ucuacucacagaagugucaau

SEQ ID NO: 4213 - RNA, 23 nt, Homo sapiens
uacucuggagagugacaaucaug

SEQ ID NO: 4214 - RNA, 23 nt, Homo sapiens
caugauugucacucuccagagua

SEQ ID NO: 4215 - RNA, 21 nt, Homo sapiens
auugacaccucugugagugga

SEQ ID NO: 4216 - RNA, 21 nt, Homo sapiens
uccacucacagaggugucaau

SEQ ID NO: 4217 - RNA, 22 nt, Homo sapiens
uucucaagagggaggcaaucau

SEQ ID NO: 4218 - RNA, 22 nt, Homo sapiens
augauugccucccucuugagaa

SEQ ID NO: 4219 - RNA, 22 nt, Homo sapiens
gagugccuucuuuuggagcguu

SEQ ID NO: 4220 - RNA, 22 nt, Homo sapiens
aacgcuccaaaagaaggcacuc

SEQ ID NO: 4221 - RNA, 18 nt, Homo sapiens
ugcuuccuuucagagggu

SEQ ID NO: 4222 - RNA, 18 nt, Homo sapiens
acccucugaaaggaagca

SEQ ID NO: 4223 - RNA, 22 nt, Homo sapiens
aucuggagguaagaagcacuuu

SEQ ID NO: 4224 - RNA, 22 nt, Homo sapiens
aaagugcuucuuaccuccagau

SEQ ID NO: 4225 - RNA, 22 nt, Homo sapiens
gaaagcgcuucccuuugcugga

SEQ ID NO: 4226 - RNA, 22 nt, Homo sapiens
uccagcaaagggaagcgcuuuc

SEQ ID NO: 4227 - RNA, 20 nt, Homo sapiens
cugcaaagggaagcccuuuc

SEQ ID NO: 4228 - RNA, 20 nt, Homo sapiens
gaaagggcuucccuuugcag

SEQ ID NO: 4229 - RNA, 21 nt, Homo sapiens
caaagcgcuucccuuuggagc

SEQ ID NO: 4230 - RNA, 21 nt, Homo sapiens
gcuccaaagggaagcgcuuug

SEQ ID NO: 4231 - RNA, 22 nt, Homo sapiens
cucuagagggaagcacuuucug

SEQ ID NO: 4232 - RNA, 22 nt, Homo sapiens
cagaaagugcuucccucuagag

SEQ ID NO: 4233 - RNA, 21 nt, Homo sapiens
aaagcgcuucccuucagagug

SEQ ID NO: 4234 - RNA, 21 nt, Homo sapiens
cacucugaagggaagcgcuuu

SEQ ID NO: 4235 - RNA, 22 nt, Homo sapiens
cucuagagggaagcgcuuucug

SEQ ID NO: 4236 - RNA, 22 nt, Homo sapiens
cagaaagcgcuucccucuagag

SEQ ID NO: 4237 - RNA, 22 nt, Homo sapiens
aaagugcauccuuuuagagguu

SEQ ID NO: 4238 - RNA, 22 nt, Homo sapiens
aaccucuaaaaggaugcacuuu

SEQ ID NO: 4239 - RNA, 22 nt, Homo sapiens
cucuagagggaagcgcuuucug

SEQ ID NO: 4240 - RNA, 22 nt, Homo sapiens
cagaaagcgcuucccucuagag

SEQ ID NO: 4241 - RNA, 22 nt, Homo sapiens
aaagugcaucuuuuuagaggau

SEQ ID NO: 4242 - RNA, 22 nt, Homo sapiens
auccucuaaaaagaugcacuuu

SEQ ID NO: 4243 - RNA, 22 nt, Homo sapiens
cucuagagggaagcgcuuucug

SEQ ID NO: 4244 - RNA, 22 nt, Homo sapiens
cagaaagcgcuucccucuagag

SEQ ID NO: 4245 - RNA, 21 nt, Homo sapiens
aaagugcuuccuuuuagaggg

SEQ ID NO: 4246 - RNA, 21 nt, Homo sapiens
cccucuaaaaggaagcacuuu

SEQ ID NO: 4247 - RNA, 22 nt, Homo sapiens
aaagugcuuccuuuuagagggu

SEQ ID NO: 4248 - RNA, 22 nt, Homo sapiens
acccucuaaaaggaagcacuuu

SEQ ID NO: 4249 - RNA, 22 nt, Homo sapiens
cucuagagggaagcacuuucug

SEQ ID NO: 4250 - RNA, 22 nt, Homo sapiens
cagaaagugcuucccucuagag

SEQ ID NO: 4251 - RNA, 22 nt, Homo sapiens
aaagugcuucucuuuggugggu

SEQ ID NO: 4252 - RNA, 22 nt, Homo sapiens
acccaccaaagagaagcacuuu

SEQ ID NO: 4253 - RNA, 20 nt, Homo sapiens
cuacaaagggaagcccuuuc

SEQ ID NO: 4254 - RNA, 20 nt, Homo sapiens
gaaagggcuucccuuuguag

SEQ ID NO: 4255 - RNA, 21 nt, Homo sapiens
aaagugcuuccuuuuugaggg

SEQ ID NO: 4256 - RNA, 21 nt, Homo sapiens
cccucaaaaaggaagcacuuu

SEQ ID NO: 4257 - RNA, 22 nt, Homo sapiens
aagugcuuccuuuuagaggguu

SEQ ID NO: 4258 - RNA, 22 nt, Homo sapiens
aacccucuaaaaggaagcacuu

SEQ ID NO: 4259 - RNA, 24 nt, Homo sapiens
acaaagugcuucccuuuagagugu

SEQ ID NO: 4260 - RNA, 24 nt, Homo sapiens
acacucuaaagggaagcacuuugu

SEQ ID NO: 4261 - RNA, 22 nt, Homo sapiens
aacgcacuucccuuuagagugu

SEQ ID NO: 4262 - RNA, 22 nt, Homo sapiens
acacucuaaagggaagugcguu

SEQ ID NO: 4263 - RNA, 22 nt, Homo sapiens
aaaaugguucccuuuagagugu

SEQ ID NO: 4264 - RNA, 22 nt, Homo sapiens
acacucuaaagggaaccauuuu

SEQ ID NO: 4265 - RNA, 22 nt, Homo sapiens
cucuagagggaagcgcuuucug

SEQ ID NO: 4266 - RNA, 22 nt, Homo sapiens
cagaaagcgcuucccucuagag

SEQ ID NO: 4267 - RNA, 23 nt, Homo sapiens
gaacgcgcuucccuauagagggu

SEQ ID NO: 4268 - RNA, 23 nt, Homo sapiens
acccucuauagggaagcgcguuc

SEQ ID NO: 4269 - RNA, 22 nt, Homo sapiens
cucuagagggaagcgcuuucug

SEQ ID NO: 4270 - RNA, 22 nt, Homo sapiens
cagaaagcgcuucccucuagag

SEQ ID NO: 4271 - RNA, 21 nt, Homo sapiens
gaaggcgcuucccuuuggagu

SEQ ID NO: 4272 - RNA, 21 nt, Homo sapiens
acuccaaagggaagcgccuuc

SEQ ID NO: 4273 - RNA, 20 nt, Homo sapiens
cugcaaagggaagcccuuuc

SEQ ID NO: 4274 - RNA, 20 nt, Homo sapiens
gaaagggcuucccuuugcag

SEQ ID NO: 4275 - RNA, 22 nt, Homo sapiens
ccucccacacccaaggcuugca

SEQ ID NO: 4276 - RNA, 22 nt, Homo sapiens
ugcaagccuugggugugggagg

SEQ ID NO: 4277 - RNA, 22 nt, Homo sapiens
caugccuugaguguaggaccgu

SEQ ID NO: 4278 - RNA, 22 nt, Homo sapiens
acgguccuacacucaaggcaug

SEQ ID NO: 4279 - RNA, 22 nt, Homo sapiens
aucauacaaggacaauuucuuu

SEQ ID NO: 4280 - RNA, 22 nt, Homo sapiens
aaagaaauuguccuuguaugau

SEQ ID NO: 4281 - RNA, 22 nt, Homo sapiens
ggagaaauuauccuuggugugu

SEQ ID NO: 4282 - RNA, 22 nt, Homo sapiens
acacaccaaggauaauuucucc

SEQ ID NO: 4283 - RNA, 22 nt, Homo sapiens
uggugggcacagaaucuggacu

SEQ ID NO: 4284 - RNA, 22 nt, Homo sapiens
aguccagauucugugcccacca

SEQ ID NO: 4285 - RNA, 25 nt, Homo sapiens
aaaggauucugcugucggucccacu

SEQ ID NO: 4286 - RNA, 25 nt, Homo sapiens
agugggaccgacagcagaauccuuu

SEQ ID NO: 4287 - RNA, 23 nt, Homo sapiens
ucggggaucaucaugucacgaga

SEQ ID NO: 4288 - RNA, 23 nt, Homo sapiens
ucucgugacaugaugauccccga

SEQ ID NO: 4289 - RNA, 22 nt, Homo sapiens
aaacauucgcggugcacuucuu

SEQ ID NO: 4290 - RNA, 22 nt, Homo sapiens
aagaagugcaccgcgaauguuu

SEQ ID NO: 4291 - RNA, 22 nt, Homo sapiens
auucugcauuuuuagcaaguuc

SEQ ID NO: 4292 - RNA, 22 nt, Homo sapiens
gaacuugcuaaaaaugcagaau

SEQ ID NO: 4293 - RNA, 22 nt, Homo sapiens
accugagguugugcauuucuaa

SEQ ID NO: 4294 - RNA, 22 nt, Homo sapiens
uuagaaaugcacaaccucaggu

SEQ ID NO: 4295 - RNA, 22 nt, Homo sapiens
ucagcaaacauuuauugugugc

SEQ ID NO: 4296 - RNA, 22 nt, Homo sapiens
gcacacaauaaauguuugcuga

SEQ ID NO: 4297 - RNA, 22 nt, Homo sapiens
ucaguaaauguuuauuagauga

SEQ ID NO: 4298 - RNA, 22 nt, Homo sapiens
ucaucuaauaaacauuuacuga

SEQ ID NO: 4299 - RNA, 22 nt, Homo sapiens
agcuacaguuacuuuugcacca

SEQ ID NO: 4300 - RNA, 22 nt, Homo sapiens
uggugcaaaaguaacuguagcu

SEQ ID NO: 4301 - RNA, 20 nt, Homo sapiens
uaaaaacugcaauuacuuuc

SEQ ID NO: 4302 - RNA, 20 nt, Homo sapiens
gaaaguaauugcaguuuuua

SEQ ID NO: 4303 - RNA, 23 nt, Homo sapiens
ugcaaaaguaauugcaguuuuug

SEQ ID NO: 4304 - RNA, 23 nt, Homo sapiens
caaaaacugcaauuacuuuugca

SEQ ID NO: 4305 - RNA, 22 nt, Homo sapiens
aaagaccgugacuacuuuugca

SEQ ID NO: 4306 - RNA, 22 nt, Homo sapiens
ugcaaaaguagucacggucuuu

SEQ ID NO: 4307 - RNA, 22 nt, Homo sapiens
agaaguaacuacgguuuuugca

SEQ ID NO: 4308 - RNA, 22 nt, Homo sapiens
ugcaaaaaccguaguuacuucu

SEQ ID NO: 4309 - RNA, 19 nt, Homo sapiens
aaaaaccacaauuacuuuu

SEQ ID NO: 4310 - RNA, 19 nt, Homo sapiens
aaaaguaauugugguuuuu

SEQ ID NO: 4311 - RNA, 19 nt, Homo sapiens
aaaaguaauugcggucuuu

SEQ ID NO: 4312 - RNA, 19 nt, Homo sapiens
aaagaccgcaauuacuuuu

SEQ ID NO: 4313 - RNA, 22 nt, Homo sapiens
caaaaacugcaauuacuuuugc

SEQ ID NO: 4314 - RNA, 22 nt, Homo sapiens
gcaaaaguaauugcaguuuuug

SEQ ID NO: 4315 - RNA, 22 nt, Homo sapiens
gaaaguaauugcuguuuuugcc

SEQ ID NO: 4316 - RNA, 22 nt, Homo sapiens
ggcaaaaacagcaauuacuuuc

SEQ ID NO: 4317 - RNA, 21 nt, Homo sapiens
uaaaacugcaguuauuuuugc

SEQ ID NO: 4318 - RNA, 21 nt, Homo sapiens
gcaaaaauaacugcaguuuua

SEQ ID NO: 4319 - RNA, 21 nt, Homo sapiens
aaaaguaauugcaguuuuugc

SEQ ID NO: 4320 - RNA, 21 nt, Homo sapiens
gcaaaaacugcaauuacuuuu

SEQ ID NO: 4321 - RNA, 22 nt, Homo sapiens
uaaaacccacaauuauguuugu

SEQ ID NO: 4322 - RNA, 22 nt, Homo sapiens
acaaacauaauuguggguuuua

SEQ ID NO: 4323 - RNA, 22 nt, Homo sapiens
aaaaguaauugcggguuuugcc

SEQ ID NO: 4324 - RNA, 22 nt, Homo sapiens
ggcaaaacccgcaauuacuuuu

SEQ ID NO: 4325 - RNA, 21 nt, Homo sapiens
caaaaccgcaguaacuuuugu

SEQ ID NO: 4326 - RNA, 21 nt, Homo sapiens
acaaaaguuacugcgguuuug

SEQ ID NO: 4327 - RNA, 22 nt, Homo sapiens
aaaaguuauugcgguuuuggcu

SEQ ID NO: 4328 - RNA, 22 nt, Homo sapiens
agccaaaaccgcaauaacuuuu

SEQ ID NO: 4329 - RNA, 21 nt, Homo sapiens
uggcaguuacuuuugcaccag

SEQ ID NO: 4330 - RNA, 21 nt, Homo sapiens
cuggugcaaaaguaacugcca

SEQ ID NO: 4331 - RNA, 21 nt, Homo sapiens
aaaaguaauugcgguuuuugc

SEQ ID NO: 4332 - RNA, 21 nt, Homo sapiens
gcaaaaaccgcaauuacuuuu

SEQ ID NO: 4333 - RNA, 20 nt, Homo sapiens
aaaacugcaguuacuuuugc

SEQ ID NO: 4334 - RNA, 20 nt, Homo sapiens
gcaaaaguaacugcaguuuu

SEQ ID NO: 4335 - RNA, 18 nt, Homo sapiens
aaaaguacuugcggauuu

SEQ ID NO: 4336 - RNA, 18 nt, Homo sapiens
aaauccgcaaguacuuuu

SEQ ID NO: 4337 - RNA, 20 nt, Homo sapiens
gugcaaaagucaucacgguu

SEQ ID NO: 4338 - RNA, 20 nt, Homo sapiens
aaccgugaugacuuuugcac

SEQ ID NO: 4339 - RNA, 22 nt, Homo sapiens
gcuggugcaaaaguaauggcgg

SEQ ID NO: 4340 - RNA, 22 nt, Homo sapiens
ccgccauuacuuuugcaccagc

SEQ ID NO: 4341 - RNA, 22 nt, Homo sapiens
aaaaguaaucacuguuuuugcc

SEQ ID NO: 4342 - RNA, 22 nt, Homo sapiens
ggcaaaaacagugauuacuuuu

SEQ ID NO: 4343 - RNA, 20 nt, Homo sapiens
agugccugagggaguaagag

SEQ ID NO: 4344 - RNA, 20 nt, Homo sapiens
cucuuacucccucaggcacu

SEQ ID NO: 4345 - RNA, 22 nt, Homo sapiens
ugucuuacucccucaggcacau

SEQ ID NO: 4346 - RNA, 22 nt, Homo sapiens
augugccugagggaguaagaca

SEQ ID NO: 4347 - RNA, 23 nt, Homo sapiens
agugccugagggaguaagagccc

SEQ ID NO: 4348 - RNA, 23 nt, Homo sapiens
gggcucuuacucccucaggcacu

SEQ ID NO: 4349 - RNA, 21 nt, Homo sapiens
gcgacccacucuugguuucca

SEQ ID NO: 4350 - RNA, 21 nt, Homo sapiens
uggaaaccaagagugggucgc

SEQ ID NO: 4351 - RNA, 22 nt, Homo sapiens
uuagcuuaaggaguaccagauc

SEQ ID NO: 4352 - RNA, 22 nt, Homo sapiens
gaucugguacuccuuaagcuaa

SEQ ID NO: 4353 - RNA, 21 nt, Homo sapiens
uaugguacuccuuaagcuaac

SEQ ID NO: 4354 - RNA, 21 nt, Homo sapiens
guuagcuuaaggaguaccaua

SEQ ID NO: 4355 - RNA, 19 nt, Homo sapiens
ugagcugcuguaccaaaau

SEQ ID NO: 4356 - RNA, 19 nt, Homo sapiens
auuuugguacagcagcuca

SEQ ID NO: 4357 - RNA, 22 nt, Homo sapiens
cacauaugaagugagccagcac

SEQ ID NO: 4358 - RNA, 22 nt, Homo sapiens
gugcuggcucacuucauaugug

SEQ ID NO: 4359 - RNA, 22 nt, Homo sapiens
ugcuggcucauuucauaugugu

SEQ ID NO: 4360 - RNA, 22 nt, Homo sapiens
acacauaugaaaugagccagca

SEQ ID NO: 4361 - RNA, 22 nt, Homo sapiens
uuccaugccuccuagaaguucc

SEQ ID NO: 4362 - RNA, 22 nt, Homo sapiens
ggaacuucuaggaggcauggaa

SEQ ID NO: 4363 - RNA, 22 nt, Homo sapiens
agccuuccaggagaaauggaga

SEQ ID NO: 4364 - RNA, 22 nt, Homo sapiens
ucuccauuucuccuggaaggcu

SEQ ID NO: 4365 - RNA, 22 nt, Homo sapiens
uaaaacuuuaagugugccuagg

SEQ ID NO: 4366 - RNA, 22 nt, Homo sapiens
ccuaggcacacuuaaaguuuua

SEQ ID NO: 4367 - RNA, 22 nt, Homo sapiens
uaggcacacuuaaaguuauagc

SEQ ID NO: 4368 - RNA, 22 nt, Homo sapiens
gcuauaacuuuaagugugccua

SEQ ID NO: 4369 - RNA, 22 nt, Homo sapiens
gaauauggguauauuaguuugg

SEQ ID NO: 4370 - RNA, 22 nt, Homo sapiens
ccaaacuaauauacccauauuc

SEQ ID NO: 4371 - RNA, 22 nt, Homo sapiens
aaacuaauauacccauauucug

SEQ ID NO: 4372 - RNA, 22 nt, Homo sapiens
cagaauauggguauauuaguuu

SEQ ID NO: 4373 - RNA, 22 nt, Homo sapiens
uaguucuucccuuugcccaauu

SEQ ID NO: 4374 - RNA, 22 nt, Homo sapiens
aauugggcaaagggaagaacua

SEQ ID NO: 4375 - RNA, 22 nt, Homo sapiens
cagggaaaugggaagaacuaga

SEQ ID NO: 4376 - RNA, 22 nt, Homo sapiens
ucuaguucuucccauuucccug

SEQ ID NO: 4377 - RNA, 22 nt, Homo sapiens
cugaauagcugggacuacaggu

SEQ ID NO: 4378 - RNA, 22 nt, Homo sapiens
accuguagucccagcuauucag

SEQ ID NO: 4379 - RNA, 22 nt, Homo sapiens
ugaaguaccagcuacucgagag

SEQ ID NO: 4380 - RNA, 22 nt, Homo sapiens
cucucgaguagcugguacuuca

SEQ ID NO: 4381 - RNA, 22 nt, Homo sapiens
cagagugacaagcugguuaaag

SEQ ID NO: 4382 - RNA, 22 nt, Homo sapiens
cuuuaaccagcuugucacucug

SEQ ID NO: 4383 - RNA, 22 nt, Homo sapiens
uauccagcuuguuacuauaugc

SEQ ID NO: 4384 - RNA, 22 nt, Homo sapiens
gcauauaguaacaagcuggaua

SEQ ID NO: 4385 - RNA, 21 nt, Homo sapiens
gccccgggcagugugaucauc

SEQ ID NO: 4386 - RNA, 21 nt, Homo sapiens
gaugaucacacugcccggggc

SEQ ID NO: 4387 - RNA, 18 nt, Homo sapiens
auggucaccuccgggacu

SEQ ID NO: 4388 - RNA, 18 nt, Homo sapiens
agucccggaggugaccau

SEQ ID NO: 4389 - RNA, 19 nt, Homo sapiens
aagucccacuaaugccagc

SEQ ID NO: 4390 - RNA, 19 nt, Homo sapiens
gcuggcauuagugggacuu

SEQ ID NO: 4391 - RNA, 21 nt, Homo sapiens
acuggcauuagugggacuuuu

SEQ ID NO: 4392 - RNA, 21 nt, Homo sapiens
aaaagucccacuaaugccagu

SEQ ID NO: 4393 - RNA, 23 nt, Homo sapiens
ugcacauggcaaccuagcuccca

SEQ ID NO: 4394 - RNA, 23 nt, Homo sapiens
ugggagcuagguugccaugugca

SEQ ID NO: 4395 - RNA, 21 nt, Homo sapiens
ggcugggugcucuugugcagu

SEQ ID NO: 4396 - RNA, 21 nt, Homo sapiens
acugcacaagagcacccagcc

SEQ ID NO: 4397 - RNA, 21 nt, Homo sapiens
uaaaguaaauaugcaccaaaa

SEQ ID NO: 4398 - RNA, 21 nt, Homo sapiens
uuuuggugcauauuuacuuua

SEQ ID NO: 4399 - RNA, 21 nt, Homo sapiens
aauaaaguucauguauggcaa

SEQ ID NO: 4400 - RNA, 21 nt, Homo sapiens
uugccauacaugaacuuuauu

SEQ ID NO: 4401 - RNA, 21 nt, Homo sapiens
uugccauacauagacuuuauu

SEQ ID NO: 4402 - RNA, 21 nt, Homo sapiens
aauaaagucuauguauggcaa

SEQ ID NO: 4403 - RNA, 21 nt, Homo sapiens
auacccauagcuuagcuccca

SEQ ID NO: 4404 - RNA, 21 nt, Homo sapiens
ugggagcuaagcuauggguau

SEQ ID NO: 4405 - RNA, 21 nt, Homo sapiens
ugggagcuaagcuauggguau

SEQ ID NO: 4406 - RNA, 21 nt, Homo sapiens
auacccauagcuuagcuccca

SEQ ID NO: 4407 - RNA, 22 nt, Homo sapiens
caaaguuuaagauccuugaagu

SEQ ID NO: 4408 - RNA, 22 nt, Homo sapiens
acuucaaggaucuuaaacuuug

SEQ ID NO: 4409 - RNA, 22 nt, Homo sapiens
aucaaggaucuuaaacuuugcc

SEQ ID NO: 4410 - RNA, 22 nt, Homo sapiens
ggcaaaguuuaagauccuugau

SEQ ID NO: 4411 - RNA, 20 nt, Homo sapiens
aaaguagcuguaccauuugc

SEQ ID NO: 4412 - RNA, 20 nt, Homo sapiens
gcaaaugguacagcuacuuu

SEQ ID NO: 4413 - RNA, 19 nt, Homo sapiens
aggcacggugucagcaggc

SEQ ID NO: 4414 - RNA, 19 nt, Homo sapiens
gccugcugacaccgugccu

SEQ ID NO: 4415 - RNA, 19 nt, Homo sapiens
gggcgccugugaucccaac

SEQ ID NO: 4416 - RNA, 19 nt, Homo sapiens
guugggaucacaggcgccc

SEQ ID NO: 4417 - RNA, 23 nt, Homo sapiens
aguauguucuuccaggacagaac

SEQ ID NO: 4418 - RNA, 23 nt, Homo sapiens
guucuguccuggaagaacauacu

SEQ ID NO: 4419 - RNA, 22 nt, Homo sapiens
gagaaaugcuggacuaaucugc

SEQ ID NO: 4420 - RNA, 22 nt, Homo sapiens
gcagauuaguccagcauuucuc

SEQ ID NO: 4421 - RNA, 22 nt, Homo sapiens
agaaaggguggcaauaccucuu

SEQ ID NO: 4422 - RNA, 22 nt, Homo sapiens
aagagguauugccacccuuucu

SEQ ID NO: 4423 - RNA, 22 nt, Homo sapiens
agguauugccacccuuucuagu

SEQ ID NO: 4424 - RNA, 22 nt, Homo sapiens
acuagaaaggguggcaauaccu

SEQ ID NO: 4425 - RNA, 22 nt, Homo sapiens
guagcaccuugcaggauaaggu

SEQ ID NO: 4426 - RNA, 22 nt, Homo sapiens
accuuauccugcaaggugcuac

SEQ ID NO: 4427 - RNA, 24 nt, Homo sapiens
uacagaugcagauucucugacuuc

SEQ ID NO: 4428 - RNA, 24 nt, Homo sapiens
gaagucagagaaucugcaucugua

SEQ ID NO: 4429 - RNA, 20 nt, Homo sapiens
aacucuagccugagcaacag

SEQ ID NO: 4430 - RNA, 20 nt, Homo sapiens
cuguugcucaggcuagaguu

SEQ ID NO: 4431 - RNA, 22 nt, Homo sapiens
acagcccagcaguuaucacggg

SEQ ID NO: 4432 - RNA, 22 nt, Homo sapiens
cccgugauaacugcugggcugu

SEQ ID NO: 4433 - RNA, 21 nt, Homo sapiens
uaucguaucguauuguauugu

SEQ ID NO: 4434 - RNA, 21 nt, Homo sapiens
acaauacaauacgauacgaua

SEQ ID NO: 4435 - RNA, 22 nt, Homo sapiens
uuagaacguuuuagggucaaau

SEQ ID NO: 4436 - RNA, 22 nt, Homo sapiens
auuugacccuaaaacguucuaa

SEQ ID NO: 4437 - RNA, 22 nt, Homo sapiens
uaacaaacaccuguaaaacagc

SEQ ID NO: 4438 - RNA, 22 nt, Homo sapiens
gcuguuuuacagguguuuguua

SEQ ID NO: 4439 - RNA, 22 nt, Homo sapiens
agcauacaccuguaguccuaga

SEQ ID NO: 4440 - RNA, 22 nt, Homo sapiens
ucuaggacuacagguguaugcu

SEQ ID NO: 4441 - RNA, 21 nt, Homo sapiens
aguuaaugaauccuggaaagu

SEQ ID NO: 4442 - RNA, 21 nt, Homo sapiens
acuuuccaggauucauuaacu

SEQ ID NO: 4443 - RNA, 21 nt, Homo sapiens
ucagcuacuaccucuauuagg

SEQ ID NO: 4444 - RNA, 21 nt, Homo sapiens
ccuaauagagguaguagcuga

SEQ ID NO: 4445 - RNA, 22 nt, Homo sapiens
uugcucugagcuccgagaaagc

SEQ ID NO: 4446 - RNA, 22 nt, Homo sapiens
gcuuucucggagcucagagcaa

SEQ ID NO: 4447 - RNA, 22 nt, Homo sapiens
caaauaauaccacagugggugu

SEQ ID NO: 4448 - RNA, 22 nt, Homo sapiens
acacccacugugguauuauuug

SEQ ID NO: 4449 - RNA, 20 nt, Homo sapiens
aauaauaucacaguaggugu

SEQ ID NO: 4450 - RNA, 20 nt, Homo sapiens
acaccuacugugauauuauu

SEQ ID NO: 4451 - RNA, 22 nt, Homo sapiens
aauaauaucacaguagguguac

SEQ ID NO: 4452 - RNA, 22 nt, Homo sapiens
guacaccuacugugauauuauu

SEQ ID NO: 4453 - RNA, 22 nt, Homo sapiens
gcaguggcucugaaaugaacuc

SEQ ID NO: 4454 - RNA, 22 nt, Homo sapiens
gaguucauuucagagccacugc

SEQ ID NO: 4455 - RNA, 21 nt, Homo sapiens
cagaucaugggacugucucag

SEQ ID NO: 4456 - RNA, 21 nt, Homo sapiens
cugagacagucccaugaucug

SEQ ID NO: 4457 - RNA, 22 nt, Homo sapiens
acuccaagaagaaucuagacag

SEQ ID NO: 4458 - RNA, 22 nt, Homo sapiens
cugucuagauucuucuuggagu

SEQ ID NO: 4459 - RNA, 22 nt, Homo sapiens
cucauuuaaguagucugaugcc

SEQ ID NO: 4460 - RNA, 22 nt, Homo sapiens
ggcaucagacuacuuaaaugag

SEQ ID NO: 4461 - RNA, 22 nt, Homo sapiens
ucaaguaguuucaugauaaagg

SEQ ID NO: 4462 - RNA, 22 nt, Homo sapiens
ccuuuaucaugaaacuacuuga

SEQ ID NO: 4463 - RNA, 22 nt, Homo sapiens
ugggggagugcagugauugugg

SEQ ID NO: 4464 - RNA, 22 nt, Homo sapiens
ccacaaucacugcacuccccca

SEQ ID NO: 4465 - RNA, 22 nt, Homo sapiens
uccugucuuuccuuguuggagc

SEQ ID NO: 4466 - RNA, 22 nt, Homo sapiens
gcuccaacaaggaaagacagga

SEQ ID NO: 4467 - RNA, 22 nt, Homo sapiens
uaaugcauuaaauuauugaagg

SEQ ID NO: 4468 - RNA, 22 nt, Homo sapiens
ccuucaauaauuuaaugcauua

SEQ ID NO: 4469 - RNA, 19 nt, Homo sapiens
uuauugucacguucugauu

SEQ ID NO: 4470 - RNA, 19 nt, Homo sapiens
aaucagaacgugacaauaa

SEQ ID NO: 4471 - RNA, 22 nt, Homo sapiens
ugagucagcaacauaucccaug

SEQ ID NO: 4472 - RNA, 22 nt, Homo sapiens
caugggauauguugcugacuca

SEQ ID NO: 4473 - RNA, 18 nt, Homo sapiens
aggagaagucgggaaggu

SEQ ID NO: 4474 - RNA, 18 nt, Homo sapiens
accuucccgacuucuccu

SEQ ID NO: 4475 - RNA, 22 nt, Homo sapiens
cgaaaacagcaauuaccuuugc

SEQ ID NO: 4476 - RNA, 22 nt, Homo sapiens
gcaaagguaauugcuguuuucg

SEQ ID NO: 4477 - RNA, 22 nt, Homo sapiens
uuaggccaucaucccauuaugc

SEQ ID NO: 4478 - RNA, 22 nt, Homo sapiens
gcauaaugggaugauggccuaa

SEQ ID NO: 4479 - RNA, 23 nt, Homo sapiens
uguuucggggcucauggccugug

SEQ ID NO: 4480 - RNA, 23 nt, Homo sapiens
cacaggccaugagccccgaaaca

SEQ ID NO: 4481 - RNA, 22 nt, Homo sapiens
aaagguaauugcaguuuuuccc

SEQ ID NO: 4482 - RNA, 22 nt, Homo sapiens
gggaaaaacugcaauuaccuuu

SEQ ID NO: 4483 - RNA, 22 nt, Homo sapiens
uucuggauaacaugcugaagcu

SEQ ID NO: 4484 - RNA, 22 nt, Homo sapiens
agcuucagcauguuauccagaa

SEQ ID NO: 4485 - RNA, 22 nt, Homo sapiens
acguuugaaugcuguacaaggc

SEQ ID NO: 4486 - RNA, 22 nt, Homo sapiens
gccuuguacagcauucaaacgu

SEQ ID NO: 4487 - RNA, 20 nt, Homo sapiens
augagcgacugugccugacc

SEQ ID NO: 4488 - RNA, 20 nt, Homo sapiens
ggucaggcacagucgcucau

SEQ ID NO: 4489 - RNA, 19 nt, Homo sapiens
gagccaguuggacaggagc

SEQ ID NO: 4490 - RNA, 19 nt, Homo sapiens
gcuccuguccaacuggcuc

SEQ ID NO: 4491 - RNA, 23 nt, Homo sapiens
uucauuugguauaaaccgcgauu

SEQ ID NO: 4492 - RNA, 23 nt, Homo sapiens
aaucgcgguuuauaccaaaugaa

SEQ ID NO: 4493 - RNA, 22 nt, Homo sapiens
uugagaaugaugaaucauuagg

SEQ ID NO: 4494 - RNA, 22 nt, Homo sapiens
ccuaaugauucaucauucucaa

SEQ ID NO: 4495 - RNA, 23 nt, Homo sapiens
uuacaguuguucaaccaguuacu

SEQ ID NO: 4496 - RNA, 23 nt, Homo sapiens
aguaacugguugaacaacuguaa

SEQ ID NO: 4497 - RNA, 21 nt, Homo sapiens
caaagaggaaggucccauuac

SEQ ID NO: 4498 - RNA, 21 nt, Homo sapiens
guaaugggaccuuccucuuug

SEQ ID NO: 4499 - RNA, 22 nt, Homo sapiens
ucaguuccaggccaaccaggcu

SEQ ID NO: 4500 - RNA, 22 nt, Homo sapiens
agccugguuggccuggaacuga

SEQ ID NO: 4501 - RNA, 22 nt, Homo sapiens
uuaugguuugccugggacugag

SEQ ID NO: 4502 - RNA, 22 nt, Homo sapiens
cucagucccaggcaaaccauaa

SEQ ID NO: 4503 - RNA, 19 nt, Homo sapiens
ugggcguaucuguaugcua

SEQ ID NO: 4504 - RNA, 19 nt, Homo sapiens
uagcauacagauacgccca

SEQ ID NO: 4505 - RNA, 20 nt, Homo sapiens
agaccauggguucucauugu

SEQ ID NO: 4506 - RNA, 20 nt, Homo sapiens
acaaugagaacccauggucu

SEQ ID NO: 4507 - RNA, 22 nt, Homo sapiens
uugugucaauaugcgaugaugu

SEQ ID NO: 4508 - RNA, 22 nt, Homo sapiens
acaucaucgcauauugacacaa

SEQ ID NO: 4509 - RNA, 19 nt, Homo sapiens
ugucucugcugggguuucu

SEQ ID NO: 4510 - RNA, 19 nt, Homo sapiens
agaaaccccagcagagaca

SEQ ID NO: 4511 - RNA, 25 nt, Homo sapiens
aggcaccagccaggcauugcucagc

SEQ ID NO: 4512 - RNA, 25 nt, Homo sapiens
gcugagcaaugccuggcuggugccu

SEQ ID NO: 4513 - RNA, 21 nt, Homo sapiens
gaagugugccguggugugucu

SEQ ID NO: 4514 - RNA, 21 nt, Homo sapiens
agacacaccacggcacacuuc

SEQ ID NO: 4515 - RNA, 21 nt, Homo sapiens
aagccugcccggcuccucggg

SEQ ID NO: 4516 - RNA, 21 nt, Homo sapiens
cccgaggagccgggcaggcuu

SEQ ID NO: 4517 - RNA, 20 nt, Homo sapiens
guugugucaguuuaucaaac

SEQ ID NO: 4518 - RNA, 20 nt, Homo sapiens
guuugauaaacugacacaac

SEQ ID NO: 4519 - RNA, 22 nt, Homo sapiens
uggucuaggauuguuggaggag

SEQ ID NO: 4520 - RNA, 22 nt, Homo sapiens
cuccuccaacaauccuagacca

SEQ ID NO: 4521 - RNA, 22 nt, Homo sapiens
cacacacugcaauuacuuuugc

SEQ ID NO: 4522 - RNA, 22 nt, Homo sapiens
gcaaaaguaauugcagugugug

SEQ ID NO: 4523 - RNA, 25 nt, Homo sapiens
aggggugguguugggacagcuccgu

SEQ ID NO: 4524 - RNA, 25 nt, Homo sapiens
acggagcugucccaacaccaccccu

SEQ ID NO: 4525 - RNA, 21 nt, Homo sapiens
ugagcuaaaugugugcuggga

SEQ ID NO: 4526 - RNA, 21 nt, Homo sapiens
ucccagcacacauuuagcuca

SEQ ID NO: 4527 - RNA, 23 nt, Homo sapiens
gcgaggaccccucggggucugac

SEQ ID NO: 4528 - RNA, 23 nt, Homo sapiens
gucagaccccgagggguccucgc

SEQ ID NO: 4529 - RNA, 25 nt, Homo sapiens
gcugggcagggcuucugagcuccuu

SEQ ID NO: 4530 - RNA, 25 nt, Homo sapiens
aaggagcucagaagcccugcccagc

SEQ ID NO: 4531 - RNA, 20 nt, Homo sapiens
gggaaaaggaagggggagga

SEQ ID NO: 4532 - RNA, 20 nt, Homo sapiens
uccucccccuuccuuuuccc

SEQ ID NO: 4533 - RNA, 20 nt, Homo sapiens
gcggaaggcggagcggcgga

SEQ ID NO: 4534 - RNA, 20 nt, Homo sapiens
uccgccgcuccgccuuccgc

SEQ ID NO: 4535 - RNA, 18 nt, Homo sapiens
gugaaggcccggcggaga

SEQ ID NO: 4536 - RNA, 18 nt, Homo sapiens
ucuccgccgggccuucac

SEQ ID NO: 4537 - RNA, 19 nt, Homo sapiens
ugagggagugggugggagg

SEQ ID NO: 4538 - RNA, 19 nt, Homo sapiens
ccucccacccacucccuca

SEQ ID NO: 4539 - RNA, 19 nt, Homo sapiens
acuggaauuggagucaaaa

SEQ ID NO: 4540 - RNA, 19 nt, Homo sapiens
uuuugacuccaauuccagu

SEQ ID NO: 4541 - RNA, 19 nt, Homo sapiens
ugagggaguuggguguaua

SEQ ID NO: 4542 - RNA, 19 nt, Homo sapiens
uauacacccaacucccuca

SEQ ID NO: 4543 - RNA, 19 nt, Homo sapiens
ugagggaguggauuguaug

SEQ ID NO: 4544 - RNA, 19 nt, Homo sapiens
cauacaauccacucccuca

SEQ ID NO: 4545 - RNA, 19 nt, Homo sapiens
ggcuggucagaugggagug

SEQ ID NO: 4546 - RNA, 19 nt, Homo sapiens
cacucccaucugaccagcc

SEQ ID NO: 4547 - RNA, 19 nt, Homo sapiens
agcagggcuggggauugca

SEQ ID NO: 4548 - RNA, 19 nt, Homo sapiens
ugcaauccccagcccugcu

SEQ ID NO: 4549 - RNA, 19 nt, Homo sapiens
ugagggaggagguugggua

SEQ ID NO: 4550 - RNA, 19 nt, Homo sapiens
uacccaaccuccucccuca

SEQ ID NO: 4551 - RNA, 19 nt, Homo sapiens
ugaggugguaggauguaga

SEQ ID NO: 4552 - RNA, 19 nt, Homo sapiens
ucuacauccuaccaccuca

SEQ ID NO: 4553 - RNA, 22 nt, Homo sapiens
uccgagccugggucucccucuu

SEQ ID NO: 4554 - RNA, 22 nt, Homo sapiens
aagagggagacccaggcucgga

SEQ ID NO: 4555 - RNA, 22 nt, Homo sapiens
ggggguccccggugcucggauc

SEQ ID NO: 4556 - RNA, 22 nt, Homo sapiens
gauccgagcaccggggaccccc

SEQ ID NO: 4557 - RNA, 22 nt, Homo sapiens
agucauuggaggguuugagcag

SEQ ID NO: 4558 - RNA, 22 nt, Homo sapiens
cugcucaaacccuccaaugacu

SEQ ID NO: 4559 - RNA, 19 nt, Homo sapiens
cagcaggaggugaggggag

SEQ ID NO: 4560 - RNA, 19 nt, Homo sapiens
cuccccucaccuccugcug

SEQ ID NO: 4561 - RNA, 22 nt, Homo sapiens
acucaaaacccuucagugacuu

SEQ ID NO: 4562 - RNA, 22 nt, Homo sapiens
aagucacugaaggguuuugagu

SEQ ID NO: 4563 - RNA, 22 nt, Homo sapiens
agacuucccauuugaagguggc

SEQ ID NO: 4564 - RNA, 22 nt, Homo sapiens
gccaccuucaaaugggaagucu

SEQ ID NO: 4565 - RNA, 23 nt, Homo sapiens
aaacucuacuuguccuucugagu

SEQ ID NO: 4566 - RNA, 23 nt, Homo sapiens
acucagaaggacaaguagaguuu

SEQ ID NO: 4567 - RNA, 21 nt, Homo sapiens
ggcuagcaacagcgcuuaccu

SEQ ID NO: 4568 - RNA, 21 nt, Homo sapiens
agguaagcgcuguugcuagcc

SEQ ID NO: 4569 - RNA, 21 nt, Homo sapiens
acagucugcugagguuggagc

SEQ ID NO: 4570 - RNA, 21 nt, Homo sapiens
gcuccaaccucagcagacugu

SEQ ID NO: 4571 - RNA, 23 nt, Homo sapiens
aucccuugcaggggcuguugggu

SEQ ID NO: 4572 - RNA, 23 nt, Homo sapiens
acccaacagccccugcaagggau

SEQ ID NO: 4573 - RNA, 22 nt, Homo sapiens
gugagucucuaagaaaagagga

SEQ ID NO: 4574 - RNA, 22 nt, Homo sapiens
uccucuuuucuuagagacucac

SEQ ID NO: 4575 - RNA, 21 nt, Homo sapiens
ucuaguaagaguggcagucga

SEQ ID NO: 4576 - RNA, 21 nt, Homo sapiens
ucgacugccacucuuacuaga

SEQ ID NO: 4577 - RNA, 22 nt, Homo sapiens
augcugacauauuuacuagagg

SEQ ID NO: 4578 - RNA, 22 nt, Homo sapiens
ccucuaguaaauaugucagcau

SEQ ID NO: 4579 - RNA, 22 nt, Homo sapiens
guucucccaacguaagcccagc

SEQ ID NO: 4580 - RNA, 22 nt, Homo sapiens
gcugggcuuacguugggagaac

SEQ ID NO: 4581 - RNA, 21 nt, Homo sapiens
uggguuuacguugggagaacu

SEQ ID NO: 4582 - RNA, 21 nt, Homo sapiens
aguucucccaacguaaaccca

SEQ ID NO: 4583 - RNA, 19 nt, Homo sapiens
gugucugcuuccuguggga

SEQ ID NO: 4584 - RNA, 19 nt, Homo sapiens
ucccacaggaagcagacac

SEQ ID NO: 4585 - RNA, 23 nt, Homo sapiens
cuaauaguaucuaccacaauaaa

SEQ ID NO: 4586 - RNA, 23 nt, Homo sapiens
uuuauugugguagauacuauuag

SEQ ID NO: 4587 - RNA, 23 nt, Homo sapiens
ugugcuugcucgucccgcccgca

SEQ ID NO: 4588 - RNA, 23 nt, Homo sapiens
ugcgggcgggacgagcaagcaca

SEQ ID NO: 4589 - RNA, 25 nt, Homo sapiens
agggaucgcgggcggguggcggccu

SEQ ID NO: 4590 - RNA, 25 nt, Homo sapiens
aggccgccacccgcccgcgaucccu

SEQ ID NO: 4591 - RNA, 21 nt, Homo sapiens
augauccaggaaccugccucu

SEQ ID NO: 4592 - RNA, 21 nt, Homo sapiens
agaggcagguuccuggaucau

SEQ ID NO: 4593 - RNA, 19 nt, Homo sapiens
aguguggcuuucuuagagc

SEQ ID NO: 4594 - RNA, 19 nt, Homo sapiens
gcucuaagaaagccacacu

SEQ ID NO: 4595 - RNA, 19 nt, Homo sapiens
ucuaggcugguacugcuga

SEQ ID NO: 4596 - RNA, 19 nt, Homo sapiens
ucagcaguaccagccuaga

SEQ ID NO: 4597 - RNA, 19 nt, Homo sapiens
aagcagcugccucugaggc

SEQ ID NO: 4598 - RNA, 19 nt, Homo sapiens
gccucagaggcagcugcuu

SEQ ID NO: 4599 - RNA, 21 nt, Homo sapiens
guggcugcacucacuuccuuc

SEQ ID NO: 4600 - RNA, 21 nt, Homo sapiens
gaaggaagugagugcagccac

SEQ ID NO: 4601 - RNA, 21 nt, Homo sapiens
aggaggcagcgcucucaggac

SEQ ID NO: 4602 - RNA, 21 nt, Homo sapiens
guccugagagcgcugccuccu

SEQ ID NO: 4603 - RNA, 21 nt, Homo sapiens
aauggcgccacuaggguugug

SEQ ID NO: 4604 - RNA, 21 nt, Homo sapiens
cacaacccuaguggcgccauu

SEQ ID NO: 4605 - RNA, 25 nt, Homo sapiens
caacccuaggagagggugccauuca

SEQ ID NO: 4606 - RNA, 25 nt, Homo sapiens
ugaauggcacccucuccuaggguug

SEQ ID NO: 4607 - RNA, 22 nt, Homo sapiens
auaauacaugguuaaccucuuu

SEQ ID NO: 4608 - RNA, 22 nt, Homo sapiens
aaagagguuaaccauguauuau

SEQ ID NO: 4609 - RNA, 21 nt, Homo sapiens
aauauuauacagucaaccucu

SEQ ID NO: 4610 - RNA, 21 nt, Homo sapiens
agagguugacuguauaauauu

SEQ ID NO: 4611 - RNA, 25 nt, Homo sapiens
ggcggagggaaguagguccguuggu

SEQ ID NO: 4612 - RNA, 25 nt, Homo sapiens
accaacggaccuacuucccuccgcc

SEQ ID NO: 4613 - RNA, 24 nt, Homo sapiens
ugccugggucucuggccugcgcgu

SEQ ID NO: 4614 - RNA, 24 nt, Homo sapiens
acgcgcaggccagagacccaggca

SEQ ID NO: 4615 - RNA, 22 nt, Homo sapiens
aggcggggcgccgcgggaccgc

SEQ ID NO: 4616 - RNA, 22 nt, Homo sapiens
gcggucccgcggcgccccgccu

SEQ ID NO: 4617 - RNA, 22 nt, Homo sapiens
gguggcccggccgugccugagg

SEQ ID NO: 4618 - RNA, 22 nt, Homo sapiens
ccucaggcacggccgggccacc

SEQ ID NO: 4619 - RNA, 20 nt, Homo sapiens
accaggaggcugaggccccu

SEQ ID NO: 4620 - RNA, 20 nt, Homo sapiens
aggggccucagccuccuggu

SEQ ID NO: 4621 - RNA, 20 nt, Homo sapiens
gucccugaguguauguggug

SEQ ID NO: 4622 - RNA, 20 nt, Homo sapiens
caccacauacacucagggac

SEQ ID NO: 4623 - RNA, 21 nt, Homo sapiens
uccgguucucagggcuccacc

SEQ ID NO: 4624 - RNA, 21 nt, Homo sapiens
gguggagcccugagaaccgga

SEQ ID NO: 4625 - RNA, 23 nt, Homo sapiens
aggaagcccuggaggggcuggag

SEQ ID NO: 4626 - RNA, 23 nt, Homo sapiens
cuccagccccuccagggcuuccu

SEQ ID NO: 4627 - RNA, 20 nt, Homo sapiens
cuguaugcccucaccgcuca

SEQ ID NO: 4628 - RNA, 20 nt, Homo sapiens
ugagcggugagggcauacag

SEQ ID NO: 4629 - RNA, 23 nt, Homo sapiens
uggugcggagagggcccacagug

SEQ ID NO: 4630 - RNA, 23 nt, Homo sapiens
cacugugggcccucuccgcacca

SEQ ID NO: 4631 - RNA, 22 nt, Homo sapiens
caacuagacugugagcuucuag

SEQ ID NO: 4632 - RNA, 22 nt, Homo sapiens
cuagaagcucacagucuaguug

SEQ ID NO: 4633 - RNA, 23 nt, Homo sapiens
aaggagcuuacaaucuagcuggg

SEQ ID NO: 4634 - RNA, 23 nt, Homo sapiens
cccagcuagauuguaagcuccuu

SEQ ID NO: 4635 - RNA, 22 nt, Homo sapiens
gggacccagggagagacguaag

SEQ ID NO: 4636 - RNA, 22 nt, Homo sapiens
cuuacgucucucccuggguccc

SEQ ID NO: 4637 - RNA, 22 nt, Homo sapiens
gcagagugcaaacaauuuugac

SEQ ID NO: 4638 - RNA, 22 nt, Homo sapiens
gucaaaauuguuugcacucugc

SEQ ID NO: 4639 - RNA, 20 nt, Homo sapiens
cggcucugggucugugggga

SEQ ID NO: 4640 - RNA, 20 nt, Homo sapiens
uccccacagacccagagccg

SEQ ID NO: 4641 - RNA, 22 nt, Homo sapiens
gcagcagggugaaacugacaca

SEQ ID NO: 4642 - RNA, 22 nt, Homo sapiens
ugugucaguuucacccugcugc

SEQ ID NO: 4643 - RNA, 21 nt, Homo sapiens
uggaggagaaggaaggugaug

SEQ ID NO: 4644 - RNA, 21 nt, Homo sapiens
caucaccuuccuucuccucca

SEQ ID NO: 4645 - RNA, 23 nt, Homo sapiens
ucugcucauaccccaugguuucu

SEQ ID NO: 4646 - RNA, 23 nt, Homo sapiens
agaaaccaugggguaugagcaga

SEQ ID NO: 4647 - RNA, 23 nt, Homo sapiens
ugcaccaugguugucugagcaug

SEQ ID NO: 4648 - RNA, 23 nt, Homo sapiens
caugcucagacaaccauggugca

SEQ ID NO: 4649 - RNA, 23 nt, Homo sapiens
cugggaucuccggggucuugguu

SEQ ID NO: 4650 - RNA, 23 nt, Homo sapiens
aaccaagaccccggagaucccag

SEQ ID NO: 4651 - RNA, 22 nt, Homo sapiens
ugagaccucuggguucugagcu

SEQ ID NO: 4652 - RNA, 22 nt, Homo sapiens
agcucagaacccagaggucuca

SEQ ID NO: 4653 - RNA, 23 nt, Homo sapiens
uccaguaccacgugucagggcca

SEQ ID NO: 4654 - RNA, 23 nt, Homo sapiens
uggcccugacacgugguacugga

SEQ ID NO: 4655 - RNA, 22 nt, Homo sapiens
ggagacugaugaguucccggga

SEQ ID NO: 4656 - RNA, 22 nt, Homo sapiens
ucccgggaacucaucagucucc

SEQ ID NO: 4657 - RNA, 21 nt, Homo sapiens
gcaggaacuugugagucuccu

SEQ ID NO: 4658 - RNA, 21 nt, Homo sapiens
aggagacucacaaguuccugc

SEQ ID NO: 4659 - RNA, 22 nt, Homo sapiens
cugcccuggcccgagggaccga

SEQ ID NO: 4660 - RNA, 22 nt, Homo sapiens
ucggucccucgggccagggcag

SEQ ID NO: 4661 - RNA, 21 nt, Homo sapiens
ccuggaaacacugagguugug

SEQ ID NO: 4662 - RNA, 21 nt, Homo sapiens
cacaaccucaguguuuccagg

SEQ ID NO: 4663 - RNA, 22 nt, Homo sapiens
uauaccucaguuuuaucaggug

SEQ ID NO: 4664 - RNA, 22 nt, Homo sapiens
caccugauaaaacugagguaua

SEQ ID NO: 4665 - RNA, 22 nt, Homo sapiens
uggugguuuacaaaguaauuca

SEQ ID NO: 4666 - RNA, 22 nt, Homo sapiens
ugaauuacuuuguaaaccacca

SEQ ID NO: 4667 - RNA, 22 nt, Homo sapiens
uggauuucuuugugaaucacca

SEQ ID NO: 4668 - RNA, 22 nt, Homo sapiens
uggugauucacaaagaaaucca

SEQ ID NO: 4669 - RNA, 21 nt, Homo sapiens
uccucuucucccuccucccag

SEQ ID NO: 4670 - RNA, 21 nt, Homo sapiens
cugggaggagggagaagagga

SEQ ID NO: 4671 - RNA, 20 nt, Homo sapiens
guagaggagauggcgcaggg

SEQ ID NO: 4672 - RNA, 20 nt, Homo sapiens
cccugcgccaucuccucuac

SEQ ID NO: 4673 - RNA, 22 nt, Homo sapiens
gugaacgggcgccaucccgagg

SEQ ID NO: 4674 - RNA, 22 nt, Homo sapiens
ccucgggauggcgcccguucac

SEQ ID NO: 4675 - RNA, 22 nt, Homo sapiens
gacugacaccucuuugggugaa

SEQ ID NO: 4676 - RNA, 22 nt, Homo sapiens
uucacccaaagaggugucaguc

SEQ ID NO: 4677 - RNA, 21 nt, Homo sapiens
uacucaaaaagcugucaguca

SEQ ID NO: 4678 - RNA, 21 nt, Homo sapiens
ugacugacagcuuuuugagua

SEQ ID NO: 4679 - RNA, 21 nt, Homo sapiens
uuaauaucggacaaccauugu

SEQ ID NO: 4680 - RNA, 21 nt, Homo sapiens
acaaugguuguccgauauuaa

SEQ ID NO: 4681 - RNA, 22 nt, Homo sapiens
auccgcgcucugacucucugcc

SEQ ID NO: 4682 - RNA, 22 nt, Homo sapiens
ggcagagagucagagcgcggau

SEQ ID NO: 4683 - RNA, 20 nt, Homo sapiens
gugagucaggguggggcugg

SEQ ID NO: 4684 - RNA, 20 nt, Homo sapiens
ccagccccacccugacucac

SEQ ID NO: 4685 - RNA, 22 nt, Homo sapiens
ugcccuuaaaggugaacccagu

SEQ ID NO: 4686 - RNA, 22 nt, Homo sapiens
acuggguucaccuuuaagggca

SEQ ID NO: 4687 - RNA, 22 nt, Homo sapiens
ucuucucuguuuuggccaugug

SEQ ID NO: 4688 - RNA, 22 nt, Homo sapiens
cacauggccaaaacagagaaga

SEQ ID NO: 4689 - RNA, 22 nt, Homo sapiens
aaauuauuguacaucggaugag

SEQ ID NO: 4690 - RNA, 22 nt, Homo sapiens
cucauccgauguacaauaauuu

SEQ ID NO: 4691 - RNA, 22 nt, Homo sapiens
uucaacggguauuuauugagca

SEQ ID NO: 4692 - RNA, 22 nt, Homo sapiens
ugcucaauaaauacccguugaa

SEQ ID NO: 4693 - RNA, 22 nt, Homo sapiens
cuauacaacuuacuacuuuccc

SEQ ID NO: 4694 - RNA, 22 nt, Homo sapiens
gggaaaguaguaaguuguauag

SEQ ID NO: 4695 - RNA, 22 nt, Homo sapiens
ugagguaguaaguuguauuguu

SEQ ID NO: 4696 - RNA, 22 nt, Homo sapiens
aacaauacaacuuacuaccuca

SEQ ID NO: 4697 - DNA, 3131 bp, Adeno-associated virus
gcggccgcgaattcgcccttggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcggaatttcaacatttgcttcacacacggggtcagagactgctcagagtgtttccccggcgtgtcagaatctcaaccggtcgtcagaaagaggacgtatcggaaactccgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcttacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacctttcaccacgtgactggcagcgactcatcaacaacaactggggattccgacccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgtccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagctagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctataagtgtggactttgctgttaatacagaaggcgtgtactctgaaccccgccccattggcacccgttacctcacccgtaatctgtaattgcctgttaatcaataaaccggttgattcgtttcagttgaactttggtctctgcgaagggcgaattc

SEQ ID NO: 4698 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSMGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEGQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPGVFTPALFASFITQYSTGQVSVEIEWELQKENSKRWNPEIQYTSNYAKSNNVEFAVNNEGVYTEPRPIGTRYLTRNL

SEQ ID NO: 4699 - protein, 644 aa, Adeno-associated virus
  MOD_RES (434)..(434): Xaa = any amino acid
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNXRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 4700 - DNA, 1933 bp, Adeno-associated virus
caaggcctacgaccagcagctcaaagcgggtgacaatccgtacctgcggtataaccacgccgacgccgagtttcaggagtgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggttgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttctccccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacgccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 4701 - protein, 644 aa, Adeno-associated virus
KAYDQQLKAGDNPYLRYNHADAEFQECLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMVAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFSPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 4702 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagccagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacacggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctgggccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgaatgggagctgcagaaagagaacagcaagcgctggaacccagagattcagtacacctccaactttgacaaacagactggagtggactttgctgttgacagccagggtgtttactctgagcct

SEQ ID NO: 4703 - protein, 644 aa, Adeno-associated virus
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSEPVPDPQPIGEPPAGPSGLGSGTMAAGGGAPMADNNEGADGVGNASGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLGRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 4704 - DNA, 1933 bp, Adeno-associated virus; identical to SEQ ID NO: 4702

SEQ ID NO: 4705 - protein, 644 aa, Adeno-associated virus; identical to SEQ ID NO: 4703

SEQ ID NO: 4706 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaatagcgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagcttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 4707 - protein, 644 aa, Adeno-associated virus
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNSEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKLASFITQYSTGQVSVEIEWELQKENSKRWNPEIQYTSNFDKQTGVDFAVDSQGVYSEP

SEQ ID NO: 4708 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggacccggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagattgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 4709 - protein, 644 aa, Adeno-associated virus
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDPEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKIASFITQYSTGQVSVEIEWELQKENSKRWNPEIQYTSNFDKQTGVDFAVDSQGVYSEP

SEQ ID NO: 4710 - protein, 728 aa, Adeno-associated virus
MAADGYLPDWLEDNLSEGIREWWDLKPGAPKPKANQQKQDDGRGLVLPGYKYLRPFNGLDKGEPVNEADAAALEHDKAYDKQLEQGDNPYLKYNHADAEFQERLQEDTSFGGNLGRAVFQAKKRVLEPLGLVEEVAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFSYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYVHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVCLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4711 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTASGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFCCLEYFPSQMLRTGNNFEFSYTFEEVPFHSSYAHSQSLDRLMNPLIDQYLYYLARTQSTTGSTRELQFHQAGPNTVAEQSKNWLPGPCYRQQRLSKNIDSNNNSNFAWTGATKYHLNGRNSLTNPGVAMATNKDDEDQFLPINGVLVFGKTGAANKTTLENVLMTSEEEIKTTNPVATEEYGVVSSNLQSSTAGPRTQTVNSQGALPGMVWQNRDVYLQGPIWAEIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4712 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSTTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSARQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKGNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4713 - DNA, 3121 bp, Adeno-associated virus
gaattcgcccttcgcagagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagccccccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgccttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgttattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggcgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgagtctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagtggagtctggagaacgctggggtgatggctctaccggtctcttctttccaggagccgtcttagcgccttcctcaaccagaccgagaggttcgagaacccgcttcttggcctggaagactgctcgtccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatctaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaagggcgaattc

SEQ ID NO: 4714 - DNA, 3121 bp, Adeno-associated virus
gaattcgcccttctacggctgcgtcaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcacgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgcgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcgatgtggatttggatgactgcatctttgaacaataaatgatttaaatcaggtatggctgccgatggttatcttccagattggctcgaggacaacctctctgagggcattcgcgagtggtgggcgctgaaacctggagccccgaagcccaaagccaaccagcaaaagcaggacggcggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgactgagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagtaacgcgtctccacgacactgtcgcaaaataacaacagcaactttgtctggaccggtgccaccaagtatcatctgaatggcagagactctctggtagatcccggtgtcgctatggcaacccacaaggacgacgaagagcgattttttccgtccagcggagtcataatgtttgggaaacagggagctggaaaagacaacgtggactatagcagcgtcatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctacctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcaggaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 4715 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDGVITTSTRTWALPTYNNHLYKQISNGTSGGSTNDNTYFGYSTPWGYFDFNRFHCHFSPRDWQRLINNNWGFRPKSLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNDNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4716 - DNA, 3121 bp, Adeno-associated virus
gaattcgcccttcgcgagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagcctcccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgtcttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgtcattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggtgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgaggctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactccgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 4717 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtga

SEQ ID NO: 4718 - protein, 737 aa, Adeno-associated virus
MAADGYLPDWLEDNLSEGIREWWDLKPGAPKPKANQQKQDNGRGLVLPGYKYLGPFNGLDKGEPVNAADAAALEHDKAYDQQLNAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYEQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSDPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWDPEIQYTSNFEKQTGVDFAVDSQGVYSEPRPIGTRYLTRNL

SEQ ID NO: 4719 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 4720 - protein, 736 aa, Adeno-associated virus
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 4721 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGRKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4722 - protein, 728 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRRQRLSKDIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4723 - protein, 685 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLTNPLIDQYLYYLARTQSTTGSTRGLQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKYTSNYYKSTNVDFAVNTEGTYSEPRPIGTRYLTRNL

SEQ ID NO: 4724 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRSL

SEQ ID NO: 4725 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4726 - protein, 733 aa, Adeno-associated virus
MAADGYLPDWLEDNLSEGIREWWDLRPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4727 - protein, 3098 aa, Adeno-associated virus
GAATTCGCCCTTTCTACGGCTGCGTCAACTGGACCAATGAGAACTTTCCCTTCAACGATTGCGTCGACAAGATGGTGATCTGGTGGGAGGAGGGCAAGATGACGGCCAAGGTCGTGGAGTCCGCCAAGGCCATTCTCGGCGGCAGCAAGGTGCGCGTGGACCAAAAGTGCAAGTCTTCCGCCCAGATCGATCCCACCCCCGTGATCGTCACTTCCAACACCAACATGTGCGCTGTGATTGACGGGAACAGCACCACCTTCGAGCACCAGCAGCCGTTACAAGACCGGATGTTCAAATTTGAACTCACCCGCCGTCTGGAGCACGACTTTGGCAAGGTGACAAAGCAGGAAGTCAAAGAGTTCTTCCGCTGGGCGCAGGATCACGTGACCGAGGTGGCGCATGAGTTCTACGTCAGAAAGGGTGGAGCCAACAAGAGACCCGCCCCCGATGACGCGGATAAAAGCGAGCCCAAGCGGGCCTGCCCCTCAGTCGCGGATCCATCGACGTCAGACGCGGAAGGAGCTCCGGTGGACTTTGCCGACAGGTACCAAAACAAATGTTCTCGTCACGCGGGCATGCTTCAGATGCTGTTTCCCTGCAAGACATGCGAGAGAATGAATCAGAATTTCAACATTTGCTTCACGCACGGGACCAGAGACTGTTCAGAATGTTTCCCCGGCGTGTCAGAATCTCAACCGGTCGTCAGAAAGAGGACGTATCGGAAACTCTGTGCCATTCATCATCTGCTGGGGCGGGCTCCCGAGATTGCTTGCTCGGCCTGCGATCTGGTCAACGTGGACCTGGATGACCGTGTTTCTGAGCAATAAATGACTTAAACCAGGTATGGCTGCCGATGGTTATCTTCCAGATTGGCTCGAGGACAACCTCTCTGAGGGCATTCGCGAGTGGTGGGACTTGAAACCTGGAGCCCCGAAACCCAAAGCCAACCAGCAAAAGCAGGACGACGGCCGGGGTCTGGTGCTTCCTGGCTACAAGTACCTCGGACCCTTCAACGGACTCGACAAGGGAGAGCCGGTCAACGAGGCAGACGCCGCGGCCCTCGAGCACGACAAGGCCTACGACAAGCAGCTCGAGCAGGGGGACAACCCGTACCTCAAGTACAACCACGCCGACGCCGAGTTTCAGGAGCGTCTTCAAGAAGATACGTCTTTTGGGGGCAACCTCGGGCGAGCAGTCTTCCAGGCCAAGAAGCGGGTTCTCGAACCTCTCGGTCTGGTTGAGGAAGGCGCTAAGACGGCTCCTGGAAAGAAGAGACCCATAGAATCCCCCGACTCCTCCACGGGCATCGGCAAGAAAGGCCAGCAGCCCGCTAAAAAGAAGCTCAACTTTGGGCAGACTGGCGACTCAGAGTCAGTGCCCGACCCCCAACCTCTCGGAGAACCTCCCGCCGCGCCCTCAGGTCTGGGATCTGGTACAATGGCTGCAGGCGGTGGCGCACCAATGGCAGACAATAACGAAGGCGCCGACGGAGTGGGTAATGCCTCCGGAAATTGGCATTGCGATTCCACATGGCTGGGCGACAGAGTCATCACCACCAGCACCCGCACCTGGGCCCTGCCCACCTACAACAACCACCTCTACAAGCAGATATCAAGTCAGAGCGGGGCTACCAACGACAACCACTTCTTCGGCTACAGCACCCCCTGGGGCTATTTTGACTTCAACAGATTCCACTGCCACTTCTCACCACGTGACTGGCAGCGACTCATCAACAACAACTGGGGATTCCGGCCCAGAAAGCTGCGGTTCAAGTTGTTCAACATCCAGGTCAAGGAGGTCACGACGAACGACGGCGTTACGACCATCGCTAATAACCTTACCAGCACGATTCAGGTCTTCTCGGACTCGGAGTACCAACTGCCGTACGTCCTCGGCTCTGCGCACCAGGGCTGCCTCCCTCCGTTCCCTGCGGACGTGTTCATGATTCCTCAGTACGGATATCTGACTCTAAACAACGGCAGTCAGTCTGTGGGACGTTCCTCCTTCTACTGCCTGGAGTACTTTCCTTCTCAGATGCTGAGAACGGGCAATAACTTTGAATTCAGCTACACCTTTGAGGAAGTGCCTTTCCACAGCAGCTATGCGCACAGCCAGAGCCTGGACCGGCTGATGAATCCCCTCATCGACCAGTACCTGTACTACCTGGCCCGGACCCAGAGCACTACGGGGTCCACAAGGGAGCTGCAGTTCCATCAGGCTGGGCCCAACACCATGGCCGAGCAATCAAAGAACTGGCTGCCCGGACCCTGTTATCGGCAGCAGAGACTGTCAAAAAACATAGACAGCAACAACAACAGTAACTTTGCCTGGACCGGGGCCACTAAATACCATCTGAATGGTAGAAATTCATTAACCAACCCGGGCGTAGCCATGGCCACCAACAAGGACGACGAGGACCAGTTCTTTCCCATCAACGGAGTGCTGGTTTTTGGCGAAACGGGGGCTGCCAACAAGACAACGCTGGAAAACGTGCTAATGACCAGCGAGGAGGAGATCAAAACCACCAATCCCGTGGCTACAGAAGAATACGGTGTGGTCTCCAGCAACCTGCAATCGTCTACGGCCGGACCCCAGACACAGACTGTCAACAGCCAGGGGGCTCTGCCCGGCATGGTCTGGCAGAACCGGGACGTGTACCTGCAGGGTCCCATCTGGGCCAAAATTCCTCACACGGACGGCAACTTTCACCCGTCTCCCCTGATGGGCGGATTTGGACTCAAACACCCGCCTCCTCAAATTCTCATCAAAAACACCCCGGTACCTGCTAATCCTCCAGAGGTGTTTACTCCTGCCAAGTTTGCCTCATTTATCACGCAGTACAGCACCGGCCAGGTCAGCGTGGAGATCGAGTGGGAACTGCAGAAAGAAAACAGCAAACGCTGGAATCCAGAGATTCAGTACACCTCAAATTATGCCAAGTCTAATAATGTGGAATTTGCTGTCAACAACGAAGGGGTTTATACTGAGCCTCGCCCCATTGGCACCCGTTACCTCACCCGTAACCTGTAATTGCCTGTTAATCAATAAACCGGTTAATTCGTTTCAGTTGAACTTTGGTCTCTGCGAAGGGCGAATTC

SEQ ID NO: 4728 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGETGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4729 - protein, 733 aa, Adeno-associated virus
MAADGHLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNSWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4730 - DNA, 2495 bp, Adeno-associated virus
gaattcgccctttctacggctgcgtcaactagaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaccagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaacagtacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 4731 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNTSNFAWTGATKYHLNGRNSLTNPGVAMATNKDDEDQFFPINGVLVFGKTGAANKTTLENVLMTSEEEIKTTNPVATEQYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4732 - DNA, 2504 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcatcacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccggctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagccggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4733 - protein, 731 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSSRDWQRLINNNWGFRPKRLNFKLFNIQVKEVTQNEGTKTIANNLTSTIQVFTDSEYRLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKPASFITQYSTGQVSVEIEWELQKENSKRWNPEIQYTSNYYKSTNVDFAVNTEGTYSEPRPIGTRYLTRNL

SEQ ID NO: 4734 - protein, 731 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFRAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNRGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMAWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4735 - protein, 738 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4736 - protein, 735 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPRKLRFKLFNIQVKEVTTDDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMDGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4737 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctagggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggctaattcgtttcagttgaactttggtctctgcgaagggcgaattc

SEQ ID NO: 4738 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4739 - DNA, 3084 bp, Adeno-associated virus
gaattcgccctttctacggctgcatcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagaaaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtccccggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggt

SEQ ID NO: 4740 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4741 - DNA, 3123 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgctccagatgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggttaattcgtttcagttgaactttggtctctgcgaagggcgaattc

SEQ ID NO: 4742 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4743 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcgccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagactggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcacggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 4744 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRLVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFTVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4745 - DNA, 3117 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcgggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagagcaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 4746 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVRVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQSNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4747 - DNA, 3121 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggcgccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcctttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggacttggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgccgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 4748 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDLEYQLPYVLGSAHQGCLPPFPADVFMVPQYGYLTLNNGSQALGRSSFYCLEYFPSQMPRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4749 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagggttcttccgctgggcgcaggatcacgtgaccgaggtggcgcatgagttccacgtgcgagcccaagcgggcctgcccctcagtcgcggatccatcgacgtcagaccagaaagggtggagccaacaagagacccgcccccgatgacgcggatataagcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaattacatgttaatcaataaaccggttaattcgtttcagttgaactttggtctctgcgaagggcgaattc

SEQ ID NO: 4750 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4751 - DNA, 2370 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagacgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtyggctcaggccaagaactggctacctggaccgtgttaccgtcagcaacgagtttccacgacactgtcgcaaaacaacaacagcaattttgctggaccggtgccacca

SEQ ID NO: 4752 - protein, 738 aa, Adeno-associated virus; identical to SEQ ID NO: 4742

SEQ ID NO: 4753 - DNA, 2205 bp, Adeno-associated virus
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 4754 - protein, 734 aa, Adeno-associated virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 4755 - DNA, 3128 bp, Adeno-associated virus
gaattcgccctttctacggctgcgtcaactggaccaatgagaactttcccttcaacgattgcgtcgacaagatgttgatctggtgggaggagggcaagatgacggccaaggtcgtggagtccgccaaggccattctcggcggcagcaaagtgcgcgtggaccaaaagtgcaagccgtccgcccagatcgaccccacccccgtgatcgtcacctccaacaccaacatgtgcgccgtgattgacgggaacagcaccaccttcgagcaccagcagccgttgcgggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactgtaaatcccggtgtcgctatggcaacccacaaggacgacgaagagcgattttgcctggaccggtgccaccaagtatcatctgaatggcagagactctctgttttccgtccagcggagtcttaatgtttgggaaacagggagctggaaaagacaacgtggactatagcagcgttatgctaaccagtgaggaagaaattaaaaccaccaacccagtggccacggaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggacttcgctgttaacacagatggcacttattctgagcctcgccccattggcacccgttacctcacccgtaatctgtaattgctcgttaatcaataaaccggttgattcgtttcagttgaactttggtctctgcgaagggcgaattc

SEQ ID NO: 4756 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4757 - DNA, 3129 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctgggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 4758 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggttgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagacccaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccattggcacccgttacctcacccgtaatctgtaattgcttgttaatcaataaaccggttgattcgtttcagttgaactttggtctctgcgaagggcgaattc

SEQ ID NO: 4759 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRPNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4760 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4761 - protein, 720 aa, Adeno-associated virus
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYL

SEQ ID NO: 4762 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4763 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4764 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4765 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4766 - protein, 728 aa, Adeno-associated virus
MAADGYLPDWLEGNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4767 - DNA, 2211 bp, Adeno-associated virus
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 4768 - protein, 736 aa, Adeno-associated virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 4769 - DNA, 2460 bp, Adeno-associated virus
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattcatggctgccgatggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttg

SEQ ID NO: 4770 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaggcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccaggccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcgcggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccagtggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccacctgacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataagccgatttatgcgtttcagttgaactttggtctctgcgaagggcgaattcgtttaaacct

SEQ ID NO: 4771 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPGPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSAVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPVASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4772 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcgggcaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagaaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcgaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacgataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcaggacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattcgcggccgcta

SEQ ID NO: 4773 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGESGQQPAKKRLNFGQTGDTESVPDPQPIGEPPAAPSGVGSNTMASGGGAPMADDNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQDTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4774 - DNA, 3113 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgttcctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaataacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcaaccaagctgggcctagctccatggctcagcaggccaaaaactggctaccgggacccagctaccgacagcagcgaatgtctaagacggctaatgacaacaacaacagtgaatttgcttggactgcagccaccaaatattacccgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacgactaatcctgtggctacagaacaatacggacaggttgccaccaaccgtcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccggaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 4775 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFNQAGPSSMAQQAKNWLPGPSYRQQRMSKTANDNNNSEFAWTAATKYYPNGRNSLVNPGPPMASHKDDEEKYFPMHGNLIFGKQGTGTTNVDIESVLITDEEEIRTTNPVATEQYGQVATNRQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4776 - DNA, 3122 bp, Adeno-associated virus
agcggccgcgaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaggtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcgcctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 4777 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNRLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4778 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLSPFPNDVFMVPQYGYCGIVTGENQNQTDRNAFYCLEYFPSQMLRTGNNFEMAYNFGKVPFHSMYAYSQSPDRLMNPLLDQYLWHLQSTTSGETLNQGNAATTFGKIRSGDFAFYRKNWLPGPCVKQQRLSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 4779 - protein, 733 aa, Adeno-associated virus
MAADGYLPDWLEDNLSEGIREWWDLKPGAPKLKANQQKQDDGRGLVLPGYKYLGPFHGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEGEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRRNPEVQFTSNYGNQSSMLWAPDTTGKYTEPRVIGSRYLTNHL

SEQ ID NO: 4780 - protein, 733 aa, Adeno-associated virus
MAADGYLPDWLEDNLSEGIREWWDLKPGAPKPKANQQKQDDGRGLVLPGYEYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFETAYNFEKVPFHSMYAHSQSLDGLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPAYPATTFTAARVDSFITQYSTGQVAVQIEWEIEKERSKRWNPEVQFTSNCGNQSSMLWAPDTTGKYTEPRVIGSRYLTNHL

SEQ ID NO: 4781 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKIPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4782 - DNA, 3127 bp, Adeno-associated virus
gcggccgcgaattcgcccttcgcagagaccaaagttcaactgaaacgaatcaaccggtttattgattaacatgcaattacagattacgggtgaggtaacgagtgccaatagggcgaggctcagagtaaacaccctggctgtcaacggcaaagtccacaccagtctgcttttcaaagttggaggtgtactgaatctccgggtcccagcgcttgctgttttccttctgcagctcccactcgatttccacgctgacttgtccggtgctgtactgtgtgatgaacgaagcaaacttggcaggagtaaacacctccggaggattagcgggaacgggagtgttcttgatcaggatctgaggaggcggatgtttaagtccaaagccgcccatcaaaggagacgggtgaaagttgccatccgtgtgaggaatcttggcccagatgggaccctgcaggtacacgtcccggttctgccagaccatgccaggtaaggctccctggttgttgacaacttgtgtctgggctgcagtattagccgcttgtaagttgctgctgactatcccgtattcttccgtggctacaggattagtaggacgaatttcttcttcatttgtcattaacacattttccaatgtagttttgttagttgctccagtttttccaaaaatcaggactccgctggatgggaaaaagcggtcctcgtcgtccttgtgagttgccatggcgacgccgggattaaccaacgagtttctgccgttcaggtgatatttggtggcaccagtccaagcaaagttgctgttgttgttttgatccagcgttttggagaccctttgttgccggaagcagggtccaggtaaccaattcttggcttgttcggccatagttgaaggcccgccctggtaaaactgcagttcccgattgccagctgtgcctcctgggtcactctgtgttctggccaggtagtacaagtactggtcgatgaggggattcatcagccggtccaggctctggctgtgtgcgtagctgctgtggaaaggcacgtcctcgaagctgtagctgaactcaaagttgttgcccgttctcagcatctgagaggggaagtactccaggcagtagaaggaggaacgtcccacagactgactgccattgttgagagtcaggtagccgtactgaggaatcatgaagacgtccgccgggaacggaggcaggcagccctggtgcgcagagccgaggacgtacggcagctggtattccgagtccgagaatacctgaatcgtgctggtaaggttattagcgatggtcgtaacgccgtcattcgtcgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtaggtgttgtcgttggtactacctgcagtttcactggagatttgctcgtagaggtggttgttgtaggtgggcagggcccaggttcgggtgctggtggtaatgactctgtcgcccagccatgtggaatcgcaatgccaatttcctgaggcattacccactccgtcggcaccttcgttattgtctgccattggtgcgccaccgcctgcagccactgtaccagatcccacactagagggcgctgctggaggttctccgagaggttgagggtcggggactgactctgagtcgccagtctgaccgaaattgagtctctttctggcgggctgctggcccttcttgccgatgcccgtggaggagtcgggggaacgctgaggtgacggctctaccggtctcttctttgcaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacgggttgtcacccgcattgagctgctggtcgtaggccttgtcgtgctcgagggccgctgcgtccgccgcgttgacgggctcccccttgtcgagtccgttgaagggtccgaggtacttgtagccaggaagcaccagaccccggccgttgtcctgcttttgctggttggctttgggtttcggggctccaggtttcaggtcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggtttagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtaatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcgatcacggcgcacatgttggtgttggagatgacgatcgcgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 4783 - DNA, 3106 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggcacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtctaggctctggctgtgcacatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagctgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgacttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtctgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcactctctcgcatgtcttgcagggaaacagcatctgaagcatgcccgcgtgacgagaacatttgttttggtacctgtcggcaaagtccaccggagctccttccgcgtctgacgtcgatggattcgcgactgaggggcaggcccgcttgggctcgcttttatccgcgtcatcgggggcgggtctcttgttggccccaccctttctgacgtagaacccatgcgccacctcggtcacgtgatcctgcgcccagcggaagaaccttttgacttcctgctttgtcaccttgccaaagttatgctccagacggcgggtgggttcaaatttgaacatccggtcctgcaacggctgctggtgctcgaaggtggcgctgttcccgtcaatcacggcgcacatgttggtgttggaggtgacggtcacgggggtggggtcgatctgggcggacgacttgcacttttggtccacgcgcaccttgctgccgccgagaatggccttggcggactccacgaccttggccgtcatcttgccctcctcccaccagatcaccatcttgtcggcgcaatcgttgaagggaaagttctcattggtccagttgacgcagccgtagaaagggcgaattc

SEQ ID NO: 4784 - DNA, 3102 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaatttcggcccagatgggaccctgcaggtacacgtcccggttctgccagaccatgccgggcagagccccctggctgttgacagtctgtgtccggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaggaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccacggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagcagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccggaagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaagcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgaagggcgaattc

SEQ ID NO: 4785 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4786 - DNA, 2187 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 4787 - protein, 728 aa, Adeno-associated virus; identical to SEQ ID NO: 4766

SEQ ID NO: 4788 - DNA, 3106 bp, Adeno-associated virus
gcggccgcgaattcgcccttcgcagagaccaaagttcaactgaaacgaatcagccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttatcgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggcggctggccgttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacctgtagccaggaagcaccagaccccggccgtcgtcctgcttttgctggttggctttgggtttcggggctccaggtttcaagtcccaccactcgcgaatgccctcagagaggttgccctcgagccaatctggaagataaccatcggcagccatacctggtttaagtcatttattgctcagaaacacagtcatccaggtccacgttggccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcaggggaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatacgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcctgccctcctcccaccagatcaccatcttgtcgacgcaatcgttgaagggaaagttctcattggtccagttgacgcagccgtagaaagggcgaattc

SEQ ID NO: 4789 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4790 - protein, 728 aa, Adeno-associated virus; identical to SEQ ID NO: 4785

SEQ ID NO: 4791 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4792 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4793 - DNA, 3098 bp, Adeno-associated virus
gaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaactaggcaggagtaaacacccctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggccctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagtagaaggaggaacgtcccatagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcagcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggcctcttgttggctccaccctttctgacgtagaactcatgcgccacctcggtcacgtgatcctgcgcccagcggaagaactctttgacttcctgctttgtcaccttgccaaagtcctgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 4794 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQGLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQPSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLPRNL

SEQ ID NO: 4795 - protein, 1458 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNLMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIGSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLLNIQVKEVTTNDGVTTIANNLTSTVQVFSDSEYQLPYVLGSAHQGCLPPFPADVFMIPQYGYLTLDNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 4796 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 4797 - DNA, 3075 bp, Adeno-associated virus
tgagaactttcctttcaacgattgcgtcggacaagatggtgatctggtgggaggaggggaagatgaccgccaaggtcgtggagtcggccaaagccattcttggaggaagcaaggtgcgtgtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcaacgtcagacgcggaagcttcgatcaactacgcggacaggtaccaaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaa

SEQ ID NO: 4798 - DNA, 3142 bp, Adeno-associated virus
aaaacgacgggccagtgattgtaatacgactcactatagggcgaaattgaaattagcggccgcgaattcgcctttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagacttgttgtagttggaagtgtactgaatttcgggattccagcgtttgctgttctccttctgcagctcccactcgatctccacgctgacctgtcccgtggaatactgtgtgatgaaagaagcaaacttggcagaactgaagtttgtgggaggattggctggaacgggagtgtttttgatcatgatctgaggaggcgggtgtttgagtccaaaacctcccatcagtggagaaggatgaaagtgtccatcggtgtgaggaatcttggcccaaatgggtccctgcaggtacacgtctcgatcctgccacaccataccaggtaacgctccttggtgattgacagttccagtagttggaccagtgtttgagttttgcaaattatttgacacagtcccgtactgctccgtagccacgggattggtggccctgatttcttcttcatctgtaatcatgacattttccaaatccgcgtcgttggcatttgttccttgtttaccaaatatcagggttccatgcatggggaaaaacttttcttcgtcatccttgtgactggccatagctggtcctggattaaccaacgagtcccggccatttagatgatactttgtagctgcagtccagggaaagttgctgttgttgttgtcgtttgcctgttttgacagacgctgctgtctgtagcaaggtccaggcagccagtttttagcttgaagagacatgttggttggtccagcttggctaaacagtagccgagactgctgaagagttccactatttgtttgtgtcttgttcagataatacaggtactggtcgatcagaggattcatcagccgatccagactctggctgtgagcgtagctgctgtggaaaggcacgtcttcaaaagtgtagctgaactgaaagttgtttccagtacgcagcatctgagaaggaaagtactccaggcagtaaaaggaagagcgtcctaccgcctgactcccgttgttcagggtgaggtatccatactgtgggaccatgaagacgtccgctggaaacggcgggaggcatccttgatgcgccgagcccaggacgtacgggagctggtactccgagtcagtaaacacctgaaccgtgctggtaaggttattggcaatcgtcgtcgtaccgtcattctgcgtgacctctttgacttgaatattaaagagcttgaagttgagtcttttgggccggaatccccggttgttgttgacgagtctttgccagtcacgtggtgaaaagtggcagtggaatctgttgaagtcaaaatacccccagggggtgctgtagccaaagtagtggttgtcgttgctggctcctgattggctggagatttgcttgtagaggtggttgttgtatgtgggcagggcccaggttcgggtgctggtggtgatgactctgtcgcccagccattgggaatcgcaatgccaatttcctgaggaattacccactccatcggcaccctcgttattgtctgccattggtgcgccactgcctgtagccattgtagtagatcccagaccagagggggctgctggtggctgtccgagaggctgggggtcaggtacggagtctgcgtctccagtctgaccaaaatttaatctttttcttgcaggctgctggcccgcttttccggttcccgaggaggagtctggctccacaggagagtgctctaccggcctcttttttcccggagccgtcttaacaggctcctcaaccaggcccagaggttcaagaaccctctttttcgcctggaagactgctcgtccgaggttgcccccaaaagacgtatcttctttaaggcgctcctgaaactctgcgtcggcgtggttgtacttgaggtacgggttgtctccgctgtcgagctgccggtcgtaggccttgtcgtgctcgagggccgcggcgtctgcctcgttgaccggctcccccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttagctccaccctttttgacgtagaattcatgctccacctcaaccacgtgatcctttgcccaccggaaaaagtctttcacttcctgcttggtgacctttccaaagtcatgatccagacggcgggtaagttcaaatttgaacatccggtcttgcaacggctgctggtgctcgaaggtcgttgagttcccgtcaatcacggcgcacatgttggtgttggaggtgacgatcacgggagtcgggtctatctgggccgaggacttgcatttctggtccacacgcaccttgcttcctccaagaatggctttggccgactccacgaccttggcggtcatcttcccctcctcccaccagatcaccatcttgtcgacgcaatggtaaaaggaaagttctcattgg

SEQ ID NO: 4799 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatggcggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacggcaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgacgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4800 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNGGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANGNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLTGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4801 - DNA, 2208 bp, Adeno-associated virus
atggctgccgatggttatcttccagattggctcgaggacactctctctgaaggaataagacagtggtggaagctcaaacctggcccaccaccaccaaagctcgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccatcagcctgcgagaaagagattgaattttggtcagactggagacgcagactccgtacctgacccccagcctctcggacagccaccagcagcccccacaagtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcacggtcccacagtatggatacctcaccctgaacaacgggagtcaggcggtaggacgctcttccttttactgcctggagtactttccttctcagatgctgcgtactggaaacaaccttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaactacagttctgccaagtttgcttctttcatcacacagtattccacgggccaggtcagcgtggagattgagtgggagctgcggaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 4802 - protein, 735 aa, Adeno-associated virus
MAADGYLPDWLEDTLSEGIRQWWKLKPGPPPPKLAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFTVPQYGYLTLNNGSQAVGRSSFYCLEYFPSQMLRTGNNLTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNYSSAKFASFITQYSTGQVSVEIEWELRKENSKRWNPEIQYTSNYNKSVNVDFTVDTNGVYSEPRPIGTRYLTRNL

SEQ ID NO: 4803 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcgtctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 4804 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYRLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4805 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgcccttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatgggaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 4806 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRPSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4807 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagaggccggtagagcactctcctgcggagccagactcctcctcgggaaccggaaaagcgggccagcagcctgcaagaaaaagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacttgggccctgcccacctacaacaaccatctctacaagcaaatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggccagccacaaggacgatgaagaaaagttttttcctcagagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctgcagggcggcaacacacaagcagctaccgcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacagattctcatcaagaacaccccggtacctgcgaatccttcgaccaccttcagtgcggcaaagtttgcttctttcatcacacagtattccacggggcaggtcagcgtggagatcgagtgggagctgcagaaggagaacagcaaacgctggaatcccgagatccagtacacttccaactacaacaaatctgttaatgtggactttactgttgacactaatggcgtgtattcagagcctcgccccattggcaccagatacctgactcgtaatctgtaa

SEQ ID NO: 4808 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4809 - DNA, 3161 bp, Adeno-associated virus
gattgaatttagcggccgcgaattcgcccttgctgcgtcaactggaccaatgagaactttccattcaatgattgcgtcgacaagatggtgatctggtgggaggagggaaagatgaccgccaaggtcatggagtcggccaaagccattctcggaggaagcaaggtgcgcgtggaccagaaatgtaagtcctcggcccagatagacccgactcccgtgattgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgggtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaggactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaaccctgcaggactagtccctttagtgagg

SEQ ID NO: 4810 - DNA, 3162 bp, Adeno-associated virus
gaattgaatttagcggccgcgaattcgcccttcgcagagaccaaagttcaactgaaacgaattaaacggtttattgattaacaagcaattacagattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaagtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccgtactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagccgctgtggaaaggaacgtcctcaaaagtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtttgtagaggtggttgttgtaggtgggcagggcccaggttcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcctggagccgtcttgacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 4811 - DNA, 3164 bp, Adeno-associated virus
gcgaattgaatttagcggccgcgaattcgcccttcgcagagaccaaagttcaactgaaacgaattaaacggtttattgattaacaagcaattacaaattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaggtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccatactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagctgctgtggaaaggaacgtcctcaaaagtgtagctgaaggtaaagttgtttccggtacgcagcatctgagaaggaaagtactccgggcagtaaaatgaagagcgtcctactgcctgactcccgttgctcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtctgtagaggtggttgttgtaggtgggcagggcccaggttcgggtgctggtggtgatgactctgtcgcccatccatgtggaatcgcaatgccgatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcccggagccgtcttaacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggcccacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 4812 - DNA, 3163 bp, Adeno-associated virus
accctcactaaagggactagtcctgcaggtttaaacgaattcgcccttgctgcgtcaactggagcaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatggattctacgtcaaaaagggtggagccaagaaaagacccgcccctagtgacgcagatataagtgagcccaaacgggtgcgcgagtcagttgcgcagccatcgacgtcggacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgcgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtgctttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcgcc

SEQ ID NO: 4813 - protein, 735 aa, Adeno-associated virus
MAADGYLPDWLEDTLSEGIRQWWKLKPGPPPPKPAERHKDDSRGLVLPGYKYLGPFNGLYKGEPVDEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDRQRLINNNWGFRPKRLNFKLFNIQVKEVTQNDGTTTIANNLTSTVQVFTDSGYQLPYVLGLAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKEDSKRWNPEIQYTSNYNKPVNVDFTVDTNGVYSEPRPIGTRYLTRNL

SEQ ID NO: 4814 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactctacaagggagagccggtcgacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttcttgaacctctgggcttggttggggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaataaccacctctacaagcaaatctccagccaatcaggagcctcaaacgacaaccactactttggctacagcaccccctgggggtattttgacttcaacagattccactgccacttttcaccacgtgaccggcaaagactcatcaacaacaactggggattccgaccaaaaagactcaacttcaagctctttaacattcaagtcaaagaggtcacgcagaatgacggtacgacgacgattgccaataaccttaccagcacggttcaggtgtttactgactcggggtaccagctcccgtacgtcctcggcttggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtggagatcgagtgggagctgcagaaggaggacagcaaacgctggaaccccgagatccagtacacttccaactataacaaacctgttaatgtggactttactgtggacactaatggtgtgtattcagagcctcgccccattggcaccagatacctgactcgtaatctgtaa

SEQ ID NO: 4815 - DNA, 3161 bp, Adeno-associated virus
cgaattgatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactggatctcgggattccagcgtttgctgttctccttctgtagctcccactcgatctccacgctgacccgccccgtggaatactgtgtgatgaaggaagcaaactttgccgcactgaaggtggtcgaaggattcgcaggtaccggggtgtttttgatgagaatctgtggaggagggtgtttaagtccgaatccgcccatgaggggagaggggtgaaaatgtccgtccgtgtgcggaatctttgcccagataggcccctgcaggtacacgtctctgtcctgccagaccatgcctggaagaacgccttgtgtgttgacatctgcagtagatgcttgtgtgttgccgctctggaggttggtagatacagaaccatactgctccgtggccacgggattggtggttctgatttcctcttcgtctgtaatcatgaccttttcaatgtccacatttgttttctctgatccttgttttccaaagatgagaaccccgctctgaggaaaaaacttttcttcatcgtccttgtggctggccattgccgggcccggattcaccagagagtctctgccattgaggtggtacttggtagctccaatccacgagtattcactgttgttgttgtccgcagatgtctttgatactcgctgctggcggtaacagggtccaggaagccagttcctagactgatcccgaatgtcactcgctccggcctgagaaaactgaagcctggactgcgtggtggttccgcttggagtgtttgttctgctcaagtaatacaggtactggtcgatgagaggattcatgagacggtccaaactctggctgtgagcgtagctgctgtggaaaggaacatcctcaaaggtgtagctgaaggtaaagttgtttccggtacgcagcatctgagaagggaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccatcattctgcgtgacctctctgacttgaatgttaaagagcttgaagttgagtctcttgggccggaatccccagttgttgttgatgagtctttgccagtcacgtggtgaaaagtggcagtggaatctgttgaagtcaaaatacccccaaggggtgctgtagccaaagtagtggttgtcgttgctggctcctgattggctggaaatctgcttgtacagatggttgttgtaggtgggcagagcccaggttcgggtgctggtggtgatgactctgtcgcccatccatgtggaatcgcaatgccaatttcccgaggaattacccactccgtcggcgccatcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctggttgcccgcttttccggttcccgaggaggagtctggctccacaggagagtgctctaccggcctcttttttcccggagccgtcttaacaggctcctcaaccaggcccagaggttcaagaaccctcttttttgcctggaagactgctcgtccgaggttgcccccaaaagacgtatcttctttaaggcgctcctgaaactccgcgtcggcgtggtcgtacttgaggtacgggttgtctccgctgtcgagctgccggtcgtaggccttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcaaagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttggctccaccctttttgacgtagaattcatgctccacctcaaccacgtgatcctttgcccaccggaaaaagtctttcacttcctgcttggtgaccttcccaaagtcatgatccagacggcgggttagttcaaatttgaacatccggtcttgcaacggctgctggtgttcgaaggtcgttgagttcccgtcaatcacggcgcacatgttggtgttggaggtggcgatcacgggagtcgggtctatctgggccgaggacttgcacttttggtccacgcgcaccttgcttcctccgagaatggcttcggccgattccacgaccttggcggtcatctttccctcctcccaccagatcaccatcttgtcgacacagtcgttgaagggaaagttctcattggtccagttgacgcagcaagggcgaattcgtttaaacctgcaggaactagtcccttagtgagg

SEQ ID NO: 4816 - protein, 735 aa, Adeno-associated virus
MAADGYLPDWLEDTLSEGIRQWWKLKPGPPPPKPAERHKDDSRGLVLPGYKYLGPFNGLYKGEPVNEADAAALEHDKAYDRQLDSGDNPYLKYNHAGAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQDSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4817 - DNA, 2208 bp, Adeno-associated virus
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactctacaagggagagccggtcaacgaggcagacgccgcggccctcgagcacgacaaggcctacgaccggcagctcgacagcggagacaacccgtacctcaagtacaaccacgccggcgcggagtttcaggagcgccttaaagaagatacgtcttttgggggcaacctcggacgagcagtcttccaggccaaaaagagggttcttgaacctctgggcttggttgaggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgaccaaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaacccttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaagactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtagagatcgagtgggagctgcagaaggagaacagcaaacgctggaaccccgagatccagtacacttccaactataacaaatctgttaatgtggactttactgtggacactaatggtgtgtattcagagcctcgccccattggcaccagatacctgactcgtaatctgtaa

SEQ ID NO: 4818 - protein, 738 aa, Adeno-associated virus
MAADGYLPDWLEDNLSEGIREWWDLKPGAPKPKANQQKQDDGRGLVLPGCKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYNKSVNVDFTVDTNGVYSEPRPIGTRYLTRNL

SEQ ID NO: 4819 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctgcaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactataacaaatctgttaatgtggactttactgtggacactaatggtgtgtattcagagcctcgccccattggcaccagatacctgactcgtaatctgtaa

SEQ ID NO: 4820 - DNA, 3167 bp, Adeno-associated virus
attgaatttagcggccgcgaattcgcccttcgcagagaccaaagttcaactgaaacgaattaaacggtttattgattaacaagcaattacagattacgagtcaggtacctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgatgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccggaatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcttgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctgctggcccgcttttccggttcccgaggaggagtctggctccgcaggagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttggggtacgggttgtctccgctgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagccgtagaaagggcgaattcgtttaaacctgcaggactagtccctttagtgagggt

SEQ ID NO: 4821 - DNA, 3161 bp, Adeno-associated virus
aattgaatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgacgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccgggatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcctgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctccttcttgcaggctgctggcccgcttttccggttcccgaggaggagtctggctccgcaagagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttgaggtacgggttgtctccgccgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagcaagggcgaattcgtttaaacctgcaggactagtccctttagtgaggg

SEQ ID NO: 4822 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcggaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccgcgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccgagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctgcgcacacagccagagctcggaccgactgatgaatcctctcatcgaccagtacctgtactacttatccagaactcggtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 4823 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcggcgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcctccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 4824 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgaaagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggagcctgttaaaacggctccgggaaaaaagaggccggtagagcactctcctgtggagccagactcctcctcgggaaccggaaaagcgggccagcagcctgcgagaaaaagattgaattttggtcagactggagacgcagactccgtacctgacccccagcctctcggacagccaccagcagccccctctggtctgggatctactacaatggcttcaggcagtggcgcaccagtggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacagctggggattccgacccaaaagactcaacttcaagctctttaacattcaagtcaaagaggtcacgcagaatgacggtacgacgacgattgccaataaccttaccagcacggttcaagtgtttaccgactcggagtaccagctcccgtacgtcctcggctcggcgcatcaaggatgcctcccgccgttcccagcagacgtctttatggtcccacagtatggatacctcaccctgaacaacgggagtcaggcggtaggacgctcttccttttactgcctggagtactttccttctcagatgctgcgtactggaaacaactttcagttcagctacacctttgaagacgttcccttccacagcagctacgctcacagccagagtctggatcggctgctgaatcctctgatcgaccagtacctatattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacacggacgggcactttcatccttctccactaatgggaggttttgggctcaaacacccgcctcctcagatcatgatcaaaaacactcccgttccagccaatcctcctacaaacttcagttcttccaagtttgcttctttcatcacacagtattccacggggcaggtcagcgtggagatcgagtgggagctgcagaaggagaacagcaaacgctggaatcccgaaattcagtatacttccaactacaacaaatctgttaatgtggactttactgtggacactaatggtgtgtattcagagcctcgccccattggcaccagatacccgactcgtaatctgtaa

SEQ ID NO: 4825 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLESGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMASGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNSWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLLNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSSKFASFITQYSTGQVSVEIEWELQKENSKRWNPEIQYTSNYNKSVNVDFTVDTNGVYSEPRPIGTRYPTRNL

SEQ ID NO: 4826 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggagaaaagaggccggtagagcactctcctgcggagccagactcctcctcgggaaccggaaaagcgggccagcagcctgcaagaaagagattgaattttggccagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggtattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcgtgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4827 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGEKRPVEHSPAEPDSSSGTGKAGQQPARKRLNFGQTGDADSVPDPQPLGQPPAAPSGLGTNTMASGSGAPMADNNEGADGVGNSSGNWYCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLVGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4828 - DNA, 2209 bp, Adeno-associated virus
atggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaat

SEQ ID NO: 4829 - protein, 735 aa, Adeno-associated virus
MAADGYPPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQRPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNRQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4830 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaggtacctcggacccttcaacggactcgacaagggagagccggtcaacgaggcagacgccgcggccctcgagcacgacaaggcctacgaccggcagctcgacagcggagacaacccgtacctcaagtacaaccacgtcgacgcggagtttcaggagcgtcttaaagaagatacgtcttttgggggcaacctcggacgagcagtcttccaggccaaaaagaggattcttgaacctctgggcctggttgaggaacctgttaaggcggctccgggagaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggcattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctccccccatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcgccagatacctgactcgtaatctgtaa

SEQ ID NO: 4831 - protein, 735 aa, Adeno-associated virus
MAADGYLPDWLEDTLSEGIRQWWKLKPGPPPPKPAERHKDDSRGLVLPGYRYLGPFNGLDKGEPVNEADAAALEHDKAYDRQLDSGDNPYLKYNHVDAEFQERLKEDTSFGGNLGRAVFQAKKRILEPLGLVEEPVKAAPGEKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGHFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPPMGGFGLKHPPPQILIKNTPVPANPSTTFSAAKFASFITQYSTGQVSVEIEWELQKENSKRWNPEIQYTSNYNKSVNVDFTVDTNGVYSEPRPIGARYLTRNL

SEQ ID NO: 4832 - DNA, 2208 bp, Adeno-associated virus
atggctgccgatggttatcttccagattggctcgaggacaccctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagataacccgtacctcaagtacaaccacgccgacgcggagtttcaggagcgccttaaagaggatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccggcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4833 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPRPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4834 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaaggagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcggcagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagacgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4835 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKGDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGGRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQTLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4836 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctgcaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtattttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctacctacctccagagcggcaacacacaagcagctacctcagatgtcaacacacaaggcgttcttccaggcatggtctggcaggacagagacgtgtacctgcgggggcccatctgggcaaagattccacacacggacggacattttcacccctctcccctcatgggcggatttggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4837 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTCNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTYLQSGNTQAATSDVNTQGVLPGMVWQDRDVYLRGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4838 - DNA, 2208 bp, Adeno-associated virus; identical to SEQ ID NO: 4832

SEQ ID NO: 4839 - protein, 735 aa, Adeno-associated virus; identical to SEQ ID NO: 4833

SEQ ID NO: 4840 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacggcagcaggggtcttgtgcttcctgggtacaagtacctcggacccttcaacggactcgacaagggagagccggtcaacgaggcagacgccgcggccctcgagcacgacaaggcctacgaccggcagctcaacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagagaccggtagagcactctcctgcggagccagactcctcctcgggaaccggaaaagcgggccagcagcctgcaagaaagagattgaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccacaagcactcgaacctgggccctgcccacctacaacaaccacctctacaagcaaatctccagccaatcaggagcctcaaacgacaaccactattttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcggacgtcttcatggtcccacagtatggatacctcaccctgaacaacgggagtcaggcggtaggacgctctcccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggaccaccaatcccgtggctacggagcagtacgggactgtgtcaaataatttgcaaaactcaaacactggtccaactactggaactgtcaatcaccaaggagcgttacctggtatggtgtggcaggatcgagatgtgtaccttcagggacccatttgggccaagattcctcacaccgatggacactttcatccttctccactgatgggaggttttggactcaaacacccgcctcctcagattatgatcaaaaacactcccgttccagccaatcctcctacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacaataatggcgtgtactcagagcctcgccccattggcaccagatacctgactcgtaatctgtaa

SEQ ID NO: 4841 - protein, 735 aa, Adeno-associated virus
MAADGYLPDWLEDTLSEGIRQWWKLKPGPPPPKPAERHKDGSRGLVLPGYKYLGPFNGLDKGEPVNEADAAALEHDKAYDRQLNSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSPFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDNNGVYSEPRPIGTRYLTRNL

SEQ ID NO: 4842 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4843 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4844 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtatttcgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgccttccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacggccaaagtctggaccgtctcatgaatcctctcatcgaccagtacctgtattacttgagcagaacaaacactccaagcggaaccaccacgatgtccaggcttcagttttctcaggccggagcaagtgacgttcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcgtctttggaaaacaagactcgggaaaaactaatgtggacattgaaaaggttatgattacagacgaagaggaaatcaggaccaccaatcccgcggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgtttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4845 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSGYQLPYVLGSAHQGCLPPFPADVFMVPQYGYLTLNNGSQAVGRSSFYCLEYFPSQMLRTGNNFTFSYTFEDVPFHSSYAHGQSLDRLMNPLIDQYLYYLSRTNTPSGTTTMSRLQFSQAGASDVRDQSRNWLPGPCYRQQRVSKTAADNNNSDYSWTGATKYHLNGRDSLVNPGPAMASHKDDEEKYFPQSGVLVFGKQDSGKTNVDIEKVMITDEEEIRTTNPAATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFVSFITQYSTGQVSVEIEWELQKENSKRWNPEIQYTSNYNKSVNVDFTVDTNGVYSEPRPIGTRYLTRNL

SEQ ID NO: 4846 - DNA, 2208 bp, Adeno-associated virus
atggctgccgatggttatcttccagattggctcgaggacactctctctgaaggaataagacagtggtggaaactcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttctggaacctctgagcctggttgaggagcctgttaagacggctccgggaaaaaagaggccggtagagcactctcccgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcaggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtcgggcaagacagagacgtgtacctgcaggggcctacttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 4847 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLSLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIQDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVGQDRDVYLQGPTWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4848 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagggtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 4849 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLGYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4850 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4851 - protein, 735 aa, Adeno-associated virus; identical to SEQ ID NO: 4850

SEQ ID NO: 4852 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgcggcctggtttgaggaaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctggacgacagagtcatcgccaccagcacccgaacctgggccctgcccacatacaacaaccacctctacaagcaaatctccagccaatcaggagcctgcaacgacaaccactactttggctacagcaccccctgggggtattttgacttcaacagattccactgccacttttcaccacgtgactggcaaagactcatcaacagcaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcccgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcactgccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaataacaactgcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggcccaccaatcccgtggctacggagcagtacgggactgtgtcaaataatttgcaaaactcaaacactggtccaactacaggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaagcactcccgttccagccaatcctcccacaaacttcagttctgccaagtttgcttcttccatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4853 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLRPGLRKPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLDDRVIATSTRTWALPTYNNHLYKQISSQSGACNDNHYFGYSTPWGYFDFNRFHCHFSPRDWQRLINSNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFQFSYTFEDVPFHSSYAHCQSLDRLMNPLIDQYLYYLNKTQTNSGTLQQSRLLFSQAGPTNMSLQAKNWLPGPCYRQQRLSKQANDNNNCNFPWTAATKYHLNGRDSLVNPGPAMASHKDDEEKFFPMHGTLIFGKQGTNANDADLENVMITDEEEIRPTNPVATEQYGTVSNNLQNSNTGPTTGTVNHQGALPGMVWQDRDVYLQGPIWAKIPHTDGHFHPSPLMGGFGLKHPPPQIMIKSTPVPANPPTNFSSAKFASSITQYSTGQVSVEIEWELQKENSKRWNPEIQYTSNYNKSVNVDFTVDTNGVYSEPRPIGTRYLTRNL

SEQ ID NO: 4854 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaggatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacagctttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttctttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 4855 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNSFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4856 - DNA, 2211 bp, Adeno-associated virus; identical to SEQ ID NO: 4767

SEQ ID NO: 4857 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGGQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVSTEGVYSEPRPIGTRYLTRNL

SEQ ID NO: 4858 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatgggagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagcgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 4859 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 4860 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccggcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4861 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTGTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4862 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcctttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgagagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4863 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNESQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4864 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtaccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4865 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4866 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtactcgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagcaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtccgttaatgtggactttactgtggacactaatggcgtgtattcagagcctcgccccattggcaccagatacctgactcgtaatctgtaa

SEQ ID NO: 4867 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAAGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4868 - protein, 738 aa, Adeno-associated virus; identical to SEQ ID NO: 4760

SEQ ID NO: 4869 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgttcggaaaacagggtgctggaagagacaatgtggactacagcagcgttatgctaaccagcgaagaagaaattaaaaccactaaccccgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4870 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNCHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4871 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGRTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYLDFNRFHCHFSPRDWQRLINNNWGFRPKRLSFKLFNIQVKEVTQNEGTKTIANNLASTIQVFTDSEYQPPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSRAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPTVGAVNSQGALPGMVWQNRDVYLQGPIWAKIPHTDGNFHPSPLMGGFGLKHPPPQILIKNTPVPADPPTAFNQAKLNSFIAQYSTGQVSVEIEWELQKENSKRWNPEIQYTSNYYKSTNADFAVNTEGVYSEPRPIGTRYLTRNL

SEQ ID NO: 4872 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcggactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagttatcaccaccagcacccgaacctgggccctgcccacctacaacaaccacctctacaagcaaatctccaacgggacctcgggaggcagcaccaacgacaacacctactttggctacagcaccccctgggggtatcttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcgccagcaccatccaggtgtttacggactcggaataccagccgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcgggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctactgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcgcgcagtacagcaccggacaagtcagcgtggagatcgagtgggagctgcagaaggagaacagcaagcgctggaacccagagattcagtatacttccaactactacaaatctacaaatgcggactttgctgttaatactgagggtgtttactctgagcctcgccccattggcactcgttacctcacccgtaatctgtaa

SEQ ID NO: 4873 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggagcctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcgtcaacaacaaccggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4874 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLVNNNRGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4875 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLSFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNSEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4876 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgagctttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattctgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4877 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGPVEEAAKTAPGKKRPVEPPPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTVANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4878 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtccggttgaggaagctgctaagacggctcctggaaagaagagaccggtagaaccgccacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccgtcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgttggaacccagagattcagtacacttcaaactactacaaatctacaaatgtggactttgctgtcaatacagagggaacttattctgagcctcgccccattggtactcgttacctcacccgtaatctgtaa

SEQ ID NO: 4879 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQSNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGLGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4880 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcggctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaagcaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggacttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4881 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTPFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIVQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 4882 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 4883 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgccttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctctccacagcagctacgcgcacagccagagcctggaccggctgatgaatcctctcatcgtccaatacctgtattacctgaacagaactcaaaatcagtccggaagtgcccaaaacaaggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccagcgttgattttactgtggacaacaatggactttatactgagcctcgccccattggcacccgttaccttacccgtcccctgtaa

SEQ ID NO: 4884 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAETAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4885 - DNA, 2211 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctgagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacccgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4886 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4887 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4888 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4889 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgcctcccgccgttcccagcagacgtcttcatggtgccacagtatggataccccaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccgtggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4890 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSGYQLPYVLGSAHQGCLPPFPADVFMVPQYGYPTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAVASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4891 - DNA, 2211 bp, Adeno-associated virus
atggctgccgacggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgggcagtcttccaggccaagaagcgggttctcgaacctctcggtctggttgaggaaggcgctaagacggctcctggaaagaaacgtccggtagagcagtcgccacaagagccagactccccctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcactgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggccgcctccctccgttcccggcggacgtgttcatgattccgcaatacggctacctgacgctcaacaatggcagccaagccgtgggacgttcatcctcttactgcctggaatatttcccttctcagatgctgagaacgggcaacaactttaccttcagctacacctttgaggaagtgcctctccacagcagctgcgcgcacagccagagcctggaccggctgatgaatcctctcatcgaccaatacctgtattacctgaacagaactcaaaatcagtccggaagtgcccaaaacagggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccgcaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4892 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSPSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGRLPPFPADVFMIPQYGYLTLNNGSQAVGRSSSYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSAGQVSVEIEWELQKENSKRWNPEVQYTSNYAKSANVDFTVDNNGLYTEPRPIGTRYLTRPL

SEQ ID NO: 4893 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4894 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacagtcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggctccagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4895 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDSHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4896 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4897 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4898 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacggcaccccctgggggtattttgatttcaacagattccactgccacttttcaccacgtgactggcagcgactcatcaacaacaattggggattccggcccaagagactcaacttcaaactcttcaacatccaagtcgaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaagcactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4899 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4900 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4901 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGANSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4902 - DNA, 2208 bp, Adeno-associated virus
atggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaa

SEQ ID NO: 4903 - protein, 735 aa, Adeno-associated virus
MAADGYLPDWLKDTLSEGIRQWWKLKPGPPPPKPAERHKDDSGGLVLPGYKYLGPFNGLDKGEPVNEADAAALEYDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGSWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVHLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4904 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcgcaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4905 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASRKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4906 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgtcaagacggctccaggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcggctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtacggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4907 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSGYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4908 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaatcggcattgcgattccacatggatgggcgacagagtcatcaccaccagcacccgaacctgggccctgcccacctacaacaaccacctctacagacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgagcaacgggagtcaggcagtaggacgctcttcattttactgcccggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacctaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatttgtaa

SEQ ID NO: 4909 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNRHCDSTWMGDRVITTSTRTWALPTYNNHLYRQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLSNGSQAVGRSSFYCPEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGPKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4910 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4911 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLRQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYYLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4912 - DNA, 3160 bp, Adeno-associated virus
acccttcactaaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcgggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaatcaatcg

SEQ ID NO: 4913 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCRFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQGLDRLMNPLIDQYLYYLNRTQTASGTQQSRLLFSQAGPTSMSLQAKNWLPGPCYRQQRLSKQANDNNNSNFPWTGATKYHLNGGDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLRGPIWAKIPHADGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4914 - DNA, 3157 bp, Adeno-associated virus
ctcactaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccactctcggaggaagcaaggtgcgcgtggaccagaaacgcaagtcctcggcccagatagatccgactcccgtgatcgtcacctccaacaccaacatgtgcgccgtgattgacgggaactcaacgaccttcgaacaccagcagccgttgcaagaccgaatgttcaaatttgaactcacccgccgtctggatcatgacttcgggaaggtcaccaagcaggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggctctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccgcttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagggtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcggagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcggggacccatttgggccaagattcctcacgccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcg

SEQ ID NO: 4915 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLECFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4916 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 4917 - DNA, 3159 bp, Adeno-associated virus
gattgatttagcggccgcgaattcgcccttgctgcgtcaactggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtccatagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgagg

SEQ ID NO: 4918 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPASPSGLGTNTMATGSGAPMADNNEGADGVGNSSGNWHCDSTWMGDRVVTTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4919 - DNA, 2205 bp, Adeno-associated virus
atggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 4920 - DNA, 3156 bp, Adeno-associated virus
cgattgaatttagcggccgcgaattcgcccttgctgcgtcaacggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagcgaatgaatcagaattcaaatatctgcttcactcacggacagaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 4921 - protein, 734 aa, Adeno-associated virus
MAADGYLPDWLEDTLSEGIRQWWKLKPGPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNEGADGVGNSSGDWHCDSTWMGDRVITTSTRTWALPTYNNHLYKQISSQSGASNDNHYFGYSTPWGYFDFNRFHCHFSPRDWQRLINNNWGFRPKRLNLKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNGEYSWTGATKYHLNGRDSLVNPGPAMASHKDDEEKFFPQSGVLIFGKQGSEKTNVDIEKVMITDEEEIRTTNPVATEQYGSVSTNLQSGNTRAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4922 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacgaccacgccgacgcggagtttcaggagcgccttaaagaagatacgtcttttgggggcaacctcggacgagcagtcttccaggcaaaaaagagggttcttgaacctctgggcctggttgaggagcctgttaagacggctccgggaaaaaagaggccggtagagcactctcctgtggagccagactcctcctcgggaaccggaaaagcgggcaaccagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgatggcgccgacggagtgggtaattcctcgggaaattggcattgcgattccacatggatgggcgacagagtcatcaccaccagcacccgaacctgggctctgcccacctacaacaaccatctgtacaagcagatttccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcagagaggtcacgcagaatgatggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtacttcccttctcagatgctgcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggatcagtctaggaactggcttcctggaccctgttaccgccagcagcgagtatcaaagacatctgcggacaacaacaacagtgaatactcgtggattggagctaccaagtaccacctcaatggcagagactctctggtgaatccgggcccggcaatggccagccacaaggacgatgaagaaaagttttttcctcagagcggggttctcatctttggaaaacaaggatcagagaaaacaaatgtggacattgaaaaggtcatgattacagacgaagaggaaatcagaaccaccaatcccgtggccacggagcagtatggttctgtatctaccaacctccagagcggcaacacacaagcatctactgcagatgtcaacacacaaggcgttcttccaggcatggtctggcaggacagagacgtgtacctgcaggggcctatctgggcaaagattccgcacacggacggacattttcacccctctcccctcatgggcggattcggacttaaacaccctcctccacagattctcatcaaaaacaccccggtacctgcgaatccttcgaccaccttcagtgcggcaaagtttgcttccttcatcacacagtattccacggggcgggtcagcgtggagatcgagtgggagctacagaaggagaacagcaaacgctggaatcccgagatccagtacacttccaactacaacaaatctgttaatgtggactttactgtggacactaatggtgtgtattcagagcctcgccccattggcaccagatacctgactcgtaatctgtaa

SEQ ID NO: 4923 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYDHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNDGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVREVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWIGATKYHLNGRDSLVNPGPAMASHKDDEEKFFPQSGVLIFGKQGSEKTNVDIEKVMITDEEEIRTTNPVATEQYGSVSTNLQSGNTQASTADVNTQGVLPGMVWQDRDVYLQGPIWAKIPHTDGHFHPSPLMGGFGLKHPPPQILIKNTPVPANPSTTFSAAKFASFITQYSTGRVSVEIEWELQKENSKRWNPEIQYTSNYNKSVNVDFTVDTNGVYSEPRPIGTRYLTRNL

SEQ ID NO: 4924 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccgcatggctgggcgacagagtcatcaccaccagcacccgaccctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 4925 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSAWLGDRVITTSTRPWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4926 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLVDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4927 - DNA, 3158 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgcggaccagaaatgcaagtcctcggcccagatagacccgactcccgtgattgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcgggcaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcactctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcaattcagctacacttttgaagacgtgcctttccacagcagctacgctcacagccagagtctggatcggctgatgaatcctctggtcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtga

SEQ ID NO: 4928 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHPPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNRLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLVGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4929 - DNA, 3159 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgtggaccagaaatgcaagtcctcggcccagatagacccgactcccgtgattgtcacctccaacaccgacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcaccctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaaccggctgcctggaccttgctacagacagcagcgtctgtcaaagcaggcaaacgacaacaacaacagcaactttccctggaccgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactggtgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 4930 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacagcggagacaacccgtaccccaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaagcagatttccagccaatcaggagcctcaaacgacaaccactactttggctacagcaccccttgggggtattttgacttcaacagattccactgccacttttcgccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcatcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccaggtacctgactcgtaatctgtaa

SEQ ID NO: 4931 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYPKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4932 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacggcggagacaacccgtacctcaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcttgcggagccagactcctcctcgggaaccggaaaagcgggccagcagcctgcaagaaggagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaggcagatttccagccaatcaggagcctcaaacgacaaccactactttggctacagcaccccttgggggtattttgacttcaacagattccactgccacttttcgccacgtgactggcaaagactcatcaacaacaattggggatcccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcgtcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccagatacctgactcgtaatctgtaa

SEQ ID NO: 4933 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSLAEPDSSSGTGKAGQQPARRRLNFGQTGDADSVPDPQPLGQPPAAPSGLGTNTMATGSGAPMADNNEGADGVGNSSGNWHCDSTWMGDRVITTSTRTWALPTYNNHLYRQISSQSGASNDNHYFGYSTPWGYFDFNRFHCHFSPRDWQRLINNNWGSRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLVDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4934 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSAGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTETIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSCAHSQSSDRLMNPLIDQYLYYLSRTRSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4935 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4936 - protein, 738 aa, Adeno-associated virus
MAADGYLPDWLEDNLSEGIREWWDLKPGAPKPKANQQKQDDGRGLVLLGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSGYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4937 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEPPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4938 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEGPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4939 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgagggacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtatcacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 4940 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4941 - DNA, 2208 bp, Adeno-associated virus
atggctgccgatggttatcttccagattggctcgaggacactctctctgaaggaacaagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 4942 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccacctgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggagggagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaactgccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4943 - protein, 735 aa, Adeno-associated virus
MAADGYLPDWLEDTLSEGTRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4944 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacaacagcaggggtcttgtgcttcctgggtacaagtacctcggaccctccaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctgcagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtacccgctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtaccggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagccttgccccattggcaccagatacctgactcgtaatctgtaa

SEQ ID NO: 4945 - protein, 735 aa, Adeno-associated virus
MAADGYLPDWLEDTLSEGIRQWWKLKPGPPPPKPAERHQDNSRGLVLPGYKYLGPSNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGCSTPWGYFDFNRFHCHFSPRDWQRLINNNWGFRPKRLNFKLFNIQVKEVTQNDGTTTIANNLTSTVQVFTDSEYPLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPCPIGTRYLTRNL

SEQ ID NO: 4946 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggcagactggcgactcagagtcagtgcctgacccccaacctctctcagaaccacccgcaggtccctctggtctgggatctggtacaatggctgctggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactgggggttccggcccaagaagctcaacttcaagctcttcaacatccaggtcaaggaggtcacccagaatgaaggcaccaagaccatcgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgagccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggcgtggtggctgacaatctgcagcagaccaactcagctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 4947 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGQTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVSPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 4948 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccggcagcccgcgaaaaagagactgaattttgggcagactggcgactcagagtcagtgcctgacccccaacctctctcagaaccacccgcaggtccctctggtctgggatctggtacaatggctgcaggcggtggcgctccaatggcagacaataacgaaggcgccgacggagtgggtaatgcctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactggggattccggcccaagaggctcaacttcaagctcttcaacatccaggtcaaggaggtcacccagaatgaaggcaccaagaccatcgccaataacctcaccagcacggtgcaggtctttacggactcgaagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 4949 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGRQPAKKRLNFGQTGDSESVPDPQPLSEPPAGPSGLGSGTMAAGGGAPMADNNEGADGVGNASGNWHCDSTWLGDRVITTSTRTWALPTYNNHLYKQISNGTSGGSSNDNTYFGYSTPWGYFDFNRFHCHFSPRDWQRLINNNWGFRPKRLNFKLFNIQVKEVTQNEGTKTIANNLTSTVQVFTDSKYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 4950 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggccgactggcgactcagagtcagtgcctgacccccaacctctctcagaaccacctgcaggtccctctggtctgggatctggtacaatggctgcaggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgcgactggcagcgactcatcaacaacaactggggattccggcccaagaagctcaacttcaagctcttcaacatccaggtcaaggaggtcacccagaatgaaggcaccaagaccaccgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacggcagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagcgaaccccgccccattggcactcgttacctcacccgtaatctgtaa

SEQ ID NO: 4951 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGPTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTTANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTAVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 4952 - DNA, 4404 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaaatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 4953 - protein, 738 aa, Adeno-associated virus; identical to SEQ ID NO: 4756

SEQ ID NO: 4954 - protein, 738 aa, Adeno-associated virus; identical to SEQ ID NO: 4756

SEQ ID NO: 4955 - DNA, 2501 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgagacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagagactcaactttgggcagactggcgactcagagtcagtgcccgaccctcaaccaatcggagaaccccccgcaggcccctctggtctgggatctggcacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtagactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttgattcgtttcagttgaactttggtctcaagggcgaattc

SEQ ID NO: 4956 - DNA, 2187 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 4957 - protein, 728 aa, Adeno-associated virus; identical to SEQ ID NO: 4728

SEQ ID NO: 4958 - protein, 728 aa, Adeno-associated virus; identical to SEQ ID NO: 4792

SEQ ID NO: 4959 - protein, 728 aa, Adeno-associated virus; identical to SEQ ID NO: 4792

SEQ ID NO: 4960 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaagacatgcgagagaatgaatcagaatttcagcatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggtcatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatagctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacagctggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4961 - DNA, 3106 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggcgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcccgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccgggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaaccggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctaccagtttgaggacgtgccctttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggcctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4962 - DNA, 3197 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattcgtttaaacctgcaggactagtccctttagtgagggttaattctgagcttggcgtaatcatgggtcatag

SEQ ID NO: 4963 - DNA, 3276 bp, Adeno-associated virus
gaattcgcccttcgcagagaccaaagttcaactgaaacgaattaaccggtttattgattaacaggcaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgtccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctatgcgcatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgtccgtcgtgacctccttgacctggatgttgaacaacttgaaccgcagctttctgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgatgtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctgtcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacacttgttttggtacctgtcggcaaagtccaccggagctccttccgcgtctgacgtcgatggatgcaaaatgtcgcaaaagcactcacgtgacagctaatacaggaccactcccctatgacgtgatttacgtcagcgctatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcctgcaacggctgctggtgctcgaaggtggtgctgttcccgtcaatcacggcgcacatgttggtgttggaagtgacgatcacgggggtgggatcgatctgggcggaagacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 4964 - protein, 738 aa, Adeno-associated virus; identical to SEQ ID NO: 4740

SEQ ID NO: 4965 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4966 - protein, 738 aa, Adeno-associated virus; identical to SEQ ID NO: 4738

SEQ ID NO: 4967 - DNA, 2489 bp, Adeno-associated virus
gaattcgccctttctacggctgcgtcaactggaccaatgagaactttcccttcaacgattgcgtcgacaagatggtgatctggtgggaggagggcaagatgacggccaaggtcgtgaagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaggaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgccaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtcaagggcgaattc

SEQ ID NO: 4968 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccggagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcggcagagactgtcaaaagacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagagaacagcaaacgctggaatccagagattcagtacacctcaaattatgccaagtctaataatgtggaatttgctgtcaacaacgaaggggtttatactgagcctcgccccattggcacccgttacctcacccgtaacctgtaattacttgttaatcaataaaccggttgattcgtttcagttgaactttggtctctgcgaagggcgaattc

SEQ ID NO: 4969 - DNA, 2969 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgacgaaccccctcatcgaccagtacctgtactacctggcccggacccagagcactacggggtccacaagggggctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4970 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtagcctgtaattgcctgttaatcaataaaccggttgattcgtttcagttgaactttggtctctgcgaagggcgaattc

SEQ ID NO: 4971 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcgcgggaccagagactgttcagaatgtttcccgggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4972 - protein, 738 aa, Adeno-associated virus; identical to SEQ ID NO: 4965

SEQ ID NO: 4973 - DNA, 1933 bp, Adeno-associated virus
  modified_base (1302)..(1302): n is a, c, t or g
  misc_feature (1302)..(1302): n is a, c, g, or t
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatgnaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 4974 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcccgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgtctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgggaaggtgccgttccactcaatgtatgcttacagccagagcccggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagactctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 4975 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 4976 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagctcaaggccaaccagcagaagcaggacgacggccggggtctggtgcttcctggctacaagtacctcggacccttccacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaaccactgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgagaaggtgccgttccactcaatgtatgctcacagccagagcctggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaaggagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgccggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 4977 - DNA, 3105 bp, Adeno-associated virus
gaattcgcccttcgcagagaccaaagttcaactgaaacgaatcacacggtttattgattaactaggcagttacaaatgattagtcaaataacgagagccaataacccgcggctctgtatacttcccagttgtatcgggagcccacaacatagaagactggttcccacagtttgaagtaaactgcacttcaggattccagcgtttggagcgttccttttcgatttcccattcaatctgaacagcgacctggccggtgctgtattgtgtgatgaaagagtccactctggctgcagtgaaggttgtcgcaggataggcaggtacgggggtgtttttgataaatatctggggaggcggatgtttcagtccaaaaccgccaattagcggtgaaggatgaaaatgtccgtccgcgtgtgggatcttggcccaaattggcccttggtagtaaatgtctctgttttgccacaccatgccaggaagcactcccatagcagtcacgttgccggttatgggagcagttgtagcattctgattattgtcagcaatctgaccaaacatgtccgtgtctcttgggttggtggcagcaatttcttcttctgatgtaaacaacagattgtttgctgaggttgttgtgtttccggtgactgatggtccagggaagatgagctgggcgttgctgaagtccccatctgaaggtccagctgttgccattggaggtccaggcgctatgttgctccagcggttgtttaaggtatagtgggtgtcatactttaacagagcgttgcccccgctggcaggaatcttgtaattttgactggcagtttttgagaatctctgctgtttaacacaaggcccaggcagccagttctttctgtaaaaggcaaagtctccactcctgatttttccaaatgtggttgctgcattgccttgattcagagtctctccagaggtggtcgactgtaagtgccacaggtactggtccaggaggggattcatcagtccgtccaggctctggctgtgagcatacattgagtggaacggcaccttctcaaagttgtaagccgtttcaaagttattgccagttctcagcatttgtgaaggaaaatactccaggcagtagaaagcatttctgtccgtctggttctgattttcgccagtcacaatgccacagtagccatattgaggcaccatgaagacgtcattggggaaaggaggcagacttccctcttgtccagcgtccatcacgtacgggagctcatacgacgagtccgcaaatatctgaaccgtgctggtaaggttattagcgaccgtagtctcgccgttcgacgttgtgacctccttaacttggatattgaagattttaacgcgcatggcttttggtcgtagtccccagttgttgttgatgagtctttgccagtcacgtggtgagaagtgacagtggaatctgttaaagtcaaagtatccccagggggtggagaatccgttgtaggtgttgctgtttgatgttgttccgagccgcaggtacaagtggttgttgtaggtgggcaagacccaggttctggtcgaggttgttgtgaccttgccctcagaccaggtggaatcgcaatgccaatcacccgaggcattacccactccatcggaaccttgtcccgcatcgacagcatttccgcccggtgctgcacgcatttcaatgtctgaagacatggcgctggtatctgatccttcagggggtccgtctccggctccagtgtcctcttcaaagttgagtctctttttggctggttgtttgccttttttgccgattcctgaggaggagtcgggctcttgtggtgactctaacggtctcttctttccaggagccgtcttagcaccttcttcaaccaggcccagaggttcgagtaccctcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtactcgtagccaggaagcaccagaccccggccgtcgtcctgcttctgctggttggccttgggcttgggggctccaggtttcaggtcccaccactcgcgaatgccctcagagaggttgtcctcgagccaatctggaagataaccgtcagcagccatacctggtttaagtcatttattgctcagaaacacagtcatccaagtccacgttgacgagatcgcaggccgaacacgcaatctcgggtgcccgccccagcagatgatgaatcgcgcacagtttctgatacgtcttttttctgacgacgggttgagattctgacgcgccggggaagcactctgagcagtctctgaccccgtgcgtgaagcagacgttgaaattctgattcattctctcgcatgtcttgcagggaaacagcatctgaagcatgcccgcgtgacgagaacatttgttttggtacctgtccgcaaggtccaccggtgcttccgcgtctgacgtcgatggctccgcaactgaggggcaggcccgcttgggctcgcttatatccgcgtcactgggggcgggtcttttggtggctccgccctttctgacgtagaactcatgcgccacctcagtcacgtgatcctgagcccagcggaagaactctttgacttcctgcttggtcaccttgccaaagtcgtgctccagacggcgggtgagctcgaacttgaacatgcggtcctgcagcggctgctggtgctcgaaggtggtgctgttcccgtcgatcacggcgcacatgttggtgttggaggtgacgatcacgggcgtggggtcgatctgggccgatgacttgcacttttggtccacgcgcaccttgcttccgcccagaatggccttggcggactccacgaccttggcggtcatcttgccctcctcccaccagatcaccatcttgtcgacgcaatcgttgaagggaaagttctcattggtccagttgacgcagcaagggcgaattc

SEQ ID NO: 4978 - DNA, 3094 bp, Adeno-associated virus
gaattcgcccttgctgcgtcaactggaccaagagaactttcccttcaacgattgcgtcgacaagatggtgatctggtgggaggagggcaagatgacggccaaggtcgtggagtccgccaaagccattctgggcggaagcaaggtgcgcgtcgaccaaaagtgcaagtcctcggcccagatcgatcccacccccgtgatcgtcacctccaacaccaacatgtgcgccgtgatcgacgggaacagcaccaccttcgagcaccagcagccgttgcaggaccggatgttcaaatttgaactcacccgccgtctggaacacgactttggcaaggtgaccaagcaggaagtcaaagagttcttccgctgggctagtgatcacgtgactgaggtgacgcatgagttctacgtcagaaagggcggagccagcaaaagacccgcccccgatgacgcggatataagcgagcccaagcgggcctgtccctcagtcacggacccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacgcacggggtcagagactgtttagaatgtttccccggcgtgtcagaatctcaaccggtcgtcagaaaaaagacgtatcggaagctgtgtgcgattcatcatctgctggggcgggcacccgagattgcttgctcggcctgcgacctggtcaacgtggacctggacgactgtgtttctgagcaataaatgacttaaaccgggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagggactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagccgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcccccgtaatctgtaattgcttgttaatcaataaaccggttgattcgtttcagttgaactttggtctctgcgaagggcgaattc

SEQ ID NO: 4979 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgtttgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgtccagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaggagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccattggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagcctatgggtctcttctttccaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagtcatttattgctcagaaacacagtcgtccaggtccacgttgaccaggtcgcaggccgagcaagcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcacctgaagcatgcccgcgtgacgagaacatttgttttggtacctgtcggcaaagtccaccggagctccttccgcgtctgacgtcgatgggtccgtgactgagggacgggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggttgctggtgctcgaaggtggtgctgttcccgtcgatcacggcgcacatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 4980 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgttcgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgttcagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccgttggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagtctatgggtctcttctttccaggagccgtcttagcgccttcctcaaccagaccgagaggttcgagaacccgcttcttggcctggaagactgctcgcccgaggttgcccccaaatgacgtatcttcttgcaggcgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagccatttattgctcagaaacacagtcgtccaggtccacgttgaccaggtcgcaggccgagcaggcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcatctgaagcatgcccgcgtggcgagaacatttgttttggtacctgtcggcaaagtccaccggagctccttccgcgtctgacgtcgatgggtccgtgactgagggacaggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggctgctggtgctcgaaggtggtgctgttcccgtcgatcacggcgcgcatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 4981 - protein, 729 aa, Adeno-associated virus; identical to SEQ ID NO: 4796

SEQ ID NO: 4982 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 4983 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 4984 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcggcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagcccttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgcactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgctacctcacccgtaatctgtaa

SEQ ID NO: 4985 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQRPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKPFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLHYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4986 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgataacttgcagcaaaccaatacggggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4987 - protein, 738 aa, Adeno-associated virus; identical to SEQ ID NO: 4760

SEQ ID NO: 4988 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 4989 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcaggatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcgggctaagaactggctacctggaccttgctaccggcagcagcgagtctctacgacactgtcgcaaaacaacaacagcaactttgcttggactggtgccaccaaatatcacctgaacggaagagactctttggtaaatcccggtgttgctatggcaacgcataaggacgacgaggaacgtttctttccatcgagcggagtcctgatgtttggaaaacagggtgctggaagagacaatgtggactatagcagcgttatgctaaccagcgaggaagaaattaaaaccactaaccctgtagccacagaacaatacggtgtggtggctgacaacttgcagcaagccaatacagggcctattgtgggaaatgtcaacagccaaggagccttacctggcatggtctggcagaaccgagacgtgtacctgcagggtcccatctgggccaaaattcctcacacggacggcaattttcacccgtctcctctgatgggcggctttggactgaagcacccacctccccagatcctgatcaagaatacgccggtacctgcggatcctccaacgacgttcagccaggcaaaattggcttccttcatcacgcagtacagcaccggccaggtcagcgtggagatcgagtgggagctgcagaaggagaacagcaagcgatggaacccagaaattcagtacacttccaactactacaaatctacaaatgtggactttgctgtcaattctgagggtacatattcagagcctcgccccattggtactcgttatctgacacgtaatctgtaa

SEQ ID NO: 4990 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggcctggtgcttcctggctacaagtacctcggacccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgttttttcccagtaacgggatcctgtttttggcaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 4991 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 4992 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcagcgcggcggacgcagcggccctcgagcacgacaaggcctgcgaccagcggctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagggaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaatcacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacgaacagactggtgtggactttgccgttgacagccagggtgtttattctgagcctcgccccattggtactcgttacctcacccgtaatctgtaa

SEQ ID NO: 4993 - protein, 737 aa, Adeno-associated virus
MAADGYLPDWLEDNLSEGIREWWDLKPGAPKPKANQQKQDDGRGLVLPGYKYLGPFNGLDKGEPVSAADAAALEHDKACDQRLKAGDNPYLRYNHADAEFQERLQEDTSFGGNLGRAVFQAKKRVLEPLGLVEEAAKTAPGKKGPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDEQTGVDFAVDSQGVYSEPRPIGTRYLTRNL

SEQ ID NO: 4994 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcgactcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatccttatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgcttactctgagcctcgccccattggcactcgttacctcacccgtaatctgtaa

SEQ ID NO: 4995 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSTQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGAYSEPRPIGTRYLTRNL

SEQ ID NO: 4996 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaaggccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 4997 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKATNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 4998 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagcacctcggacccttcaacggactcgacaagggggagcccgtcaacgcggcggacgcagcggccctcgagcacgacaaggcctacgaccagcagctcaaagcgggtgacaatccgtacctgcggtataatcacgctgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 4999 - protein, 738 aa, Adeno-associated virus
MAADGYLPDWLEDNLSEGIREWWDLKPGAPKPKANQQKQDDGRGLVLPGYKHLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5000 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5001 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacagcaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5002 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5003 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5004 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5005 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgcacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacttatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggagtaccagctgccgtacgtcctcggctctgcccaccagggctgcctgcctccgttcccggcggacgtcttcatgattcctcagtacggcaacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacatgggctatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacggcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5006 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNMGYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 5007 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccggaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcgtcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggagcccagagattcagtatacttccaactactacaaatctacaaatgtggactttgctgttaatactgagggtgtttactctgagcctcgccccattggcactcgttacctcacccgtaatctgtaa

SEQ ID NO: 5008 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAGKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLVDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWSPEIQYTSNYYKSTNVDFAVNTEGVYSEPRPIGTRYLTRNL

SEQ ID NO: 5009 - DNA, 2217 bp, Adeno-associated virus
atggttgccgatggttatcttccagattggctcgaggacaacctctctgagggcattcgcgagtggtgggacctgaaacctggagccccgaaacccaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagcttaaagcgggtgacaatccgtacctgcggtataatcacgccgacgccgagcttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgccagcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagccgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5010 - protein, 738 aa, Adeno-associated virus
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 5011 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaatagcctcaccagcaccatccaggtgtttacggactcggaataccagctgccgtacgtcctcggctctgcccaccagggctgcctgcctccgttcccggcggacgtcttcatgattcctcagtacggctacctgactcccaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgtcttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacttgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5012 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5013 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYVHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNSGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYPTRNL

SEQ ID NO: 5014 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgtgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaattcgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttaccccacccgtaatctgtaa

SEQ ID NO: 5015 - protein, 734 aa, Adeno-associated virus; identical to SEQ ID NO: 4911

SEQ ID NO: 5016 - DNA, 2214 bp, Adeno-associated virus
atggctgctgacggttatcttccagattggctcgaggacaacctctctgagggcattcgcgagtggtgggacctgaaacctggagccccgaaacccaaagccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaacctctcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcgactcatcaacaacaactggggattccggcccaagaagctcaacttcaagctcttcaacatccaagtcaaggaggtcacgacgaatgacggcgtcacgaccatcgctaataaccttaccagcacggttcaggtcttttcggactcggagtaccagctgccgtacgtcctcggctctgcccaccagggctgcctgcctccgttcccggcggacgtcttcatgattcctcagtacggctacctgactctgaacaatggcagccaatcggtgggacgttcatccttctactgcctggaatacttcccttctcaggtgctgagaacgggtaacaacttcaccttcagttacaccttcgaggacgtgcctttccacagcagctacgcgcacagccagagcctagaccggctgatgaatcccctcatcgaccagtacctgtattacctggctagaacacagagtaacccaggaggcacatctggcaatcgggaactgcagttttaccagggcgggccttccaccatggccgaacaagccaagaactggttacctggaccttgcttccggcaacaaagagtttccaaaacactggatcaaaacaacaacagcaactttgcttggactggtgccaccaaatatcacctgaacggcagaaactcattggtgaatcctggtgtcgccatggcaactcacaaggacgacgaggaccgctttttcccatccagcggagtcctgatttttggaaaaactggagcaaccaacaagactacattggaaaacgtgttaatgacaaatgaagaagaaattcgtcctactaatcctgtggccacagaagaatacgggatagtcagcagcaatttacaagcggccaatactgcagcccagacacaagttgtcaacaaccagggagccttacctggcatggtctggcagaaccgggacgtgtacctgcagggtcccatctgggccaaaattcctcacacagacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5017 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPLGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFTFSYTFEDVPFHSSYAHSQSLDRLMNPLIDQYLYYLARTQSNPGGTSGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5018 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacacggctgggcgacagagtcatcaccaccagcacccggacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacgaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5019 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQRRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5020 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcttcaggaaattggcattgcgattcccaatggctgggcgacagagtcatcaccaccagcacccgaacctgggcccagcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggagctcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccgaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 5021 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWAQPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGALQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHRGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 5022 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaacctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgcggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5023 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 5024 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaacctccagcagcgccctctagtgtgggatctggtacaatggccgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagctgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaagcactcctgttcctgcggatcctccaacagcgttcaaccaggccaagctgaattctttcatcacgcagtacagcaccggacaagtcagcgtggagatcgagtgggagctgcagaaggagaacagcaagtgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5025 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKCWNPEIQYTSNYYKSTNVDFAVNTEGVYSEPRPIGTRYLTRNL

SEQ ID NO: 5026 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5027 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccctaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5028 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNPTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5029 - DNA, 2208 bp, Adeno-associated virus
atggctgccgatggttatcttccagattggctcgaggacaacctctctgagggcattcacgagtggtgggacccgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacccacaacaaccacctctacaagcaaatctccaacgggacctcgggaggcagcaccaacgacaacgtctacttcggctacagcaccccctgggggtattttgacttcaacagattccactgtcacttctcaccacgtgaccggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacggaaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5030 - protein, 735 aa, Adeno-associated virus
MAADGYLPDWLEDNLSEGIHEWWDPKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTHNNHLYKQISNGTSGGSTNDNVYFGYSTPWGYFDFNRFHCHFSPRDRQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTEGTAGTQQLLFSQAGPSNMSAQARNWLPGPCYRQQRVSTTLSQNNNSNFAWTGATKYHLNGRDSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5031 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRPINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYPFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQDTAPIVGAVNSQGALPGMVWQNRDVYLQGPIWAKIPHTDGNFHPSPLMGGFGLKHPPPQVLIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5032 - DNA, 2217 bp, Adeno-associated virus
atggctgccgatggttatcttccagattggctcgaggacaacctctctgagggcattcgcgagtggtgggacctgaaacctggagccccgaaacccaaggccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgacccatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctaccctttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaagacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcaggtcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5033 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagttccaggagcgtctgcaagaagatacgtcttttgggggcaacctcgggcgagcagtcttccaggccaagaagcgggttctcgaacctctcggtctggctgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagagccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgggtgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatgacagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5034 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLAEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTGDGVTTIANNLTSTVQVFSDSEYQLPYVLGSAHQGCLPPFPADVFMIPQYGYLTLNNDSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5035 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgcaggaacccagagattcagtatacttccaactactacaaatctacaaatgtggactttgctgttaatactgagggtgtttactctgagcctcgccccattggcactcgttacctcacccgtaatctgtaa

SEQ ID NO: 5036 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 5037 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5038 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRWNPEIQYTSNYYKSTNVDFAVNTEGVYSEPRPIGTRYLTRNL

SEQ ID NO: 5039 - protein, 738 aa, Adeno-associated virus; identical to SEQ ID NO: 5037

SEQ ID NO: 5040 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctagaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5041 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPRPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5042 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccatgccgacgccgagtttcaggagcgtctgcaagaagatacgtcttttgggggcaacctcgggcgagcagtcctccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5043 - protein, 737 aa, Adeno-associated virus; identical to SEQ ID NO: 5003

SEQ ID NO: 5044 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVLQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5045 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccacccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggtgatcgagtgggagctgcagaaggagaacagcaagcgctggaacccagagattcagtatacttccaactactacaaatctacaaatgtggactttgctgttaatactgagggtgtttactctgagcttcgccccattggcactcgttacctcacccgtaatctgtaa

SEQ ID NO: 5046 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPPSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVVIEWELQKENSKRWNPEIQYTSNYYKSTNVDFAVNTEGVYSELRPIGTRYLTRNL

SEQ ID NO: 5047 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgccccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccatcagctacaccttcgaggacgttcccttccacagcagctacgcacacagccagagcctggaccggctgatgaatcctcttatcgaccagtacctgtattacctggccagaacacagagcaacgcaggaggcacagctggcaatcaggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5048 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTISYTFEDVPFHSSYAHSQSLDRLMNPLIDQYLYYLARTQSNAGGTAGNQELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5049 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccgcctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggatgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgagcggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattcttccatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatttgtaa

SEQ ID NO: 5050 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPAYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLSGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSSITQYSTGQVSVEIEWELQKENSKRWNPEIQYTSNYYKSTNVDFAVNTEGVYSEPRPIGTRYLTRNL

SEQ ID NO: 5051 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5052 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 5053 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQRQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5054 - protein, 736 aa, Adeno-associated virus
MAADGYLPDWLEDNLSEGIREWLNLKPGAPQPKANQQKQDNARGLVLPGYKYLGPFNGLDKGDPVNEADAAALEHDKAYGQQLKAGDNPYLKYNHADAEFQERLQKDTSFGGNLGKAVFQAKKRILEPLGLVETPAKTAPGKKRPVDPSPQRSPDSSSGIGKKSPHPARKRLNFGQTGEAESVPDPQPIGEPPSDPSSVGSGTMAAGGGAPMADNNEGADGVGNSSGNWHCDSTWLGDRVITTSTRTWALPTYNNHLYKQISSQSGATNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSKTQGTNATVQGAKLQFSQAGPSNMRDQARNWLPGPCYRQQRVSKTANDNNNSEYAWTGATKYHLNGRDSLVNPGPAMASHKDDEEKFFPMNGTLVFGKNGAGNSNVDIENVMITDEEEIRTTNPVATEQYGVVSDNLQSSNTRPITGDVDSQGVLPGMVWQDRDVYLQGPIWAKIPHTDGHFHPSPLMGGFGLKHPPPQILIKNTPVPANPATTFTPGKFASFITQYSTGQVSVQIEWELQKENSKRWNPEIQYTSNYNKSVNVDFTVDTNGVYSEPRPIGTRYLTRNL

SEQ ID NO: 5055 - protein, 736 aa, Adeno-associated virus; identical to SEQ ID NO: 4750

SEQ ID NO: 5056 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5057 - DNA, 2211 bp, Adeno-associated virus 1; identical to SEQ ID NO: 4940

SEQ ID NO: 5058 - protein, 736 aa, Adeno-associated virus 1; identical to SEQ ID NO: 5051

SEQ ID NO: 5059 - DNA, 4718 bp, Adeno-associated virus 1
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaatcgcgaagcgcctcccacgctgccgcgtcagcgctgacgtaaattacgtcataggggagtggtcctgtattagctgtcacgtgagtgcttttgcgacattttgcgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcctgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcttccaactcgcggtcccagatcaaggccgctctggacaatgccggcaagatcatggcgctgaccaaatccgcgcccgactacctggtaggccccgctccgcccgcggacattaaaaccaaccgcatctaccgcatcctggagctgaacggctacgaacctgcctacgccggctccgtctttctcggctgggcccagaaaaggttcgggaagcgcaacaccatctggctgtttgggccggccaccacgggcaagaccaacatcgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggacgagagactgttcagagtgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattacgtgttaatcaataaaccggttgattcgtttcagttgaactttggtctcctgtccttcttatcttatcggttaccatggttatagcttacacattaactgcttggttgcgcttcgcgataaaagacttacgtcatcgggttacccctagtgatggagttgcccactccctctctgcgcgctcgctcgctcggtggggcctgcggaccaaaggtccgcagacggcagagctctgctctgccggccccaccgagcgagcgagcgcgcagagagggagtgggcaa

SEQ ID NO: 5060 - DNA, 255 bp, Adeno-associated virus 10
ggtaattcctccggaaattggcattgcgattccacatggctgggcgacagagtcatcaccaccagcacccgaacctgggtcctgcccacctacaacaaccacatctacaagcaaatctccagcgagacaggagccaccaacgacaaccactacttcggctacagcaccccctgggggtattttgactttaacagattccactgccacttttcaccacgtgactggcagcgactcatcaacaacaactggggattc

SEQ ID NO: 5061 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 5062 - protein, 738 aa, Adeno-associated virus 10; identical to SEQ ID NO: 4756

SEQ ID NO: 5063 - DNA, 258 bp, Adeno-associated virus 11
ggtaattcctccggaaattggcattgcgattccacatggctgggcgacagagtcatcaccaccagcacccgaacctgggccctgccaacctacaacaaccacctctacaaacaaatctccagcgcttcaacgggggccagcaacgacaaccactactttggctacagcaccccctgggggtattttgactttaacagattccactgccacttctcaccacgtgactggcagcgactcatcaacaacaactggggattc

SEQ ID NO: 5064 - DNA, 255 bp, Adeno-associated virus 12
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattc

SEQ ID NO: 5065 - DNA, 2208 bp, Adeno-associated virus 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 5066 - protein, 735 aa, Adeno-associated virus 2 [sequence omitted]

SEQ ID NO: 5067 - protein, 621 aa, Adeno-associated virus 2
MPGFYEIVIKVPSDLDGHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 5068 - DNA, 4675 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgtacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccggccatggcaagccacaaggacgatgaagaaaagttttttcctcagagcggggttctcatctttgggaagcaaggctcagagaaaacaaatgtgaacattgaaaaggtcatgattacagacgaagaggaaatcggaacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacacggtcagcgtggagatcgagtgggagctgcagaaggaaaacagcaaacgctggaatcccgaaattcagtacacttccaactacaacaagtctgttaatcgtggacttaccgtggatactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 5069 - DNA, 4679 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 5070 - protein, 735 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQDKALLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5071 - protein, 740 aa, Adeno-associated virus 2
MAADGYLPDWLEDTLSEGIRQWWKLKPGPPPPKPAERHKDDSRGLVLPGYKYLGPFNGLDKGEPVNAADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAAA

SEQ ID NO: 5072 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATMYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 5073 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSEAKFASFITQYSTGQVSVEIEWELQKENSKRWNPEIQYTSNYNKSVNVDFTVDTNGVYSEPRPIGTRYLTRN

SEQ ID NO: 5074 - protein, 739 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAA

SEQ ID NO: 5075 - protein, 725 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRP

SEQ ID NO: 5076 - protein, 707 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSCIYQPPERQQTSSYRRCQHTRRSSRHGLAGQRCVPSGAHLGKDSTHGRTFSPLSPHGWIRTTPSSTDSHQEHPGTCESFDHLQCGKVCFLHHTVLHGTGQRGDRVRAAEGKQQTLESRNSVHFQLQQVC

SEQ ID NO: 5077 - protein, 739 aa, Adeno-associated virus 2; identical to SEQ ID NO: 5074

SEQ ID NO: 5078 - protein, 737 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHHPPQILIKNTPVPANPSTTFSAAKFASFITQYSTGQVSVEIEWELQKENSKRWNPEIQYTSNYNKSVNVDFTVDTNGVYSEPRPIGTRYLTRNLL

SEQ ID NO: 5079 - protein, 741 aa, Adeno-associated virus 2
MAADGYLPDWLEDTLSEGIREWWALKPGAPKPKANQQKQDDGRGLVLPGYKYLGPFNGLDKGEPVNEADAAALEHDKAYDQQLQAGDNPYLRYNHADAEFQERLQEDTSFGGNLGRAVFQAKKRVLEPLGLVEEPVKTAPGKKRPVEHSPVEPDSSSGTGKSGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNLANHNNTTNARQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYL

SEQ ID NO: 5080 - protein, 730 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTR

SEQ ID NO: 5081 - protein, 735 aa, Adeno-associated virus 2
  misc_feature (239)..(239): Xaa can be any naturally occurring amino acid
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5082 - protein, 733 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFLAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLT

SEQ ID NO: 5083 - protein, 734 aa, Adeno-associated virus 2
MAADGYLPDWLEDTLSEGIRQWWKLKPGPPPPKPAERHKDDSRGLVLPGCKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFSDSEYQLPYVLGSAHQGCLPPFPADVFMIPQYGYLTLNNGSQAVGRSSFYCLEYFPSQMLRTGNNFTFNYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5084 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALSTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 5085 - protein, 738 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLRP

SEQ ID NO: 5086 - protein, 736 aa, Adeno-associated virus 3; identical to SEQ ID NO: 4720

SEQ ID NO: 5087 - DNA, 4726 bp, Adeno-associated virus 3
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcgcctgccgggcatttctaactcgtttgttaactgggtggccgagaaggaatgggacgtgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttgaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacgggagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtgaatcctggttaatcaataaaccgtttaattcgtttcagttgaactttggctcttgtgcacttctttatctttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggcctggcgaccaaaggtcgccagacggacgtgctttgcacgtccggccccaccgagcgagcgagtgcgcatagagggagtggccaa

SEQ ID NO: 5088 - protein, 736 aa, Adeno-associated virus 3A; identical to SEQ ID NO: 4720

SEQ ID NO: 5089 - protein, 624 aa, Adeno-associated virus 3A
MPGFYEIVLKVPSDLDERLPGISNSFVNWVAEKEWDVPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFEFELTRRLDHDFGKVTKQEVKDFFRWASDHVTDVAHEFYVRKGGAKKRPASNDADVSEPKRECTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 5090 - protein, 736 aa, Adeno-associated virus 3B
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 5091 - protein, 624 aa, Adeno-associated virus 3B
MPGFYEIVLKVPSDLDEHLPGISNSFVNWVAEKEWELPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFKFELTRRLDHDFGKVTKQEVKDFFRWASDHVTDVAHEFYVRKGGAKKRPASNDADVSEPKRQCTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 5092 - DNA, 4722 bp, Adeno-associated virus 3B
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcacctgccgggcatttctaactcgtttgttaactgggtggccgagaaggaatgggagctgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttaaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacggcagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaatcctggttaatcaataaaccgtttaattcgtttcagttgaactttggctcttgtgcacttcttatcttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggccggacgtgcaaagcacgtccgtctggcgacctttggtcgccaggccccaccgagcgagcgagtgcgcatagagggagtggccaa

SEQ ID NO: 5093 - DNA, 1800 bp, Adeno-associated virus 4
  modified_base (342)..(342): n is a, c, t or g
  misc_feature (342)..(342): n is a, c, g, or t
acggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 5094 - DNA, 2208 bp, Adeno-associated virus 4
  modified_base (750)..(750): n is a, c, t or g
  misc_feature (750)..(750): n is a, c, g, or t
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 5095 - DNA, 1872 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataa

SEQ ID NO: 5096 - DNA, 1611 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 5097 - DNA, 1872 bp, Adeno-associated virus 4; identical to SEQ ID NO: 5095

SEQ ID NO: 5098 - DNA, 1617 bp, Adeno-associated virus 4
  modified_base (162)..(162): n is a, c, t, or g
  misc_feature (162)..(162): n is a, c, g, or t
atgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 5099 - DNA, 939 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 5100 - DNA, 1197 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaa

SEQ ID NO: 5101 - DNA, 245 bp, Adeno-associated virus 4
ctccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagc

SEQ ID NO: 5102 - protein, 313 aa, Adeno-associated virus 4
  MOD_RES (313)..(313): Xaa = any amino acid
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 5103 - protein, 399 aa, Adeno-associated virus 4
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 5104 - protein, 623 aa, Adeno-associated virus 4
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 5105 - protein, 537 aa, Adeno-associated virus 4
  MOD_RES (537)..(537): Xaa = any amino acid
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 5106 - protein, 623 aa, Adeno-associated virus 4; identical to SEQ ID NO: 5104

SEQ ID NO: 5107 - protein, 544 aa, Adeno-associated virus 4
MSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 5108 - protein, 734 aa, Adeno-associated virus 4; identical to SEQ ID NO: 4754

SEQ ID NO: 5109 - protein, 598 aa, Adeno-associated virus 4
TAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 5110 - DNA, 129 bp, Adeno-associated virus 4
ttggccactccctctatgcgcgctcgctcactcactcggccctgcggccagaggccggcagtctggagacctttggtgtccagggcagggccgagtgagtgagcgagcgcgcatagagggagtggccaa

SEQ ID NO: 5111 - DNA, 125 bp, Adeno-associated virus 4
ttggccactccctctatgcgcgctcgctcactcactcggccctggagaccaaaggtctccagactgccggcctctggccggcagggccgagtgagtgagcgagcgcgcatagagggagtggccaa

SEQ ID NO: 5112 - DNA, 4768 bp, Adeno-associated virus 4
  modified_base (3009)..(3009): n is a, c, t or g
  misc_feature (3009)..(3009): n is a, c, g, or t
ttggccactccctctatgcgcgctcgctcactcactcggccctggagaccaaaggtctccagactgccggcctctggccggcagggccgagtgagtgagcgagcgcgcatagagggagtggccaactccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagccatgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacaccgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataacctgttaatcaataaaccggtttattcgtttcagttgaactttggtctccgtgtccttcttatcttatctcgtttccatggctactgcgtacataagcagcggcctgcggcgcttgcgcttcgcggtttacaactgccggttaatcagtaacttctggcaaaccatgatgatggagttggccactccctctatgcgcgctcgctcactcactcggccctggagaccaaaggtctccagactgccggcctctggccggcagggccgagtgagtgagcgagcgcgcatagagggagtggccaa

SEQ ID NO: 5113 - protein, 725 aa, Adeno-associated virus 5
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPTTGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 5114 - protein, 724 aa, Adeno-associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 5115 - protein, 2175 aa, Adeno-associated virus 5
ATGTCTTTTGTTGATCACCCTCCAGATTGGTTGGAAGAAGTTGGTGAAGGTCTTCGCGAGTTTTTGGGCCTTGAAGCGGGCCCACCGAAACCAAAACCCAATCAGCAGCATCAAGATCAAGCCCGTGGTCTTGTGCTGCCTGGTTATAACTATCTCGGACCCGGAAACGGTCTCGATCGAGGAGAGCCTGTCAACAGGGCAGACGAGGTCGCGCGAGAGCACGACATCTCGTACAACGAGCAGCTTGAGGCGGGAGACAACCCCTACCTCAAGTACAACCACGCGGACGCCGAGTTTCAGGAGAAGCTCGCCGACGACACATCCTTCGGGGGAAACCTCGGAAAGGCAGTCTTTCAGGCCAAGAAAAGGGTTCTCGAACCTTTTGGCCTGGTTGAAGAGGGTGCTAAGACGGCCCCTACCGGAAAGCGGATAGACGACCACTTTCCAAAAAGAAAGAAGGCTCGGACCGAAGAGGACTCCAAGCCTTCCACCTCGTCAGACGCCGAAGCTGGACCCAGCGGATCCCAGCAGCTGCAAATCCCAGCCCAACCAGCCTCAAGTTTGGGAGCTGATACAATGTCTGCGGGAGGTGGCGGCCCATTGGGCGACAATAACCAAGGTGCCGATGGAGTGGGCAATGCCTCGGGAGATTGGCATTGCGATTCCACGTGGATGGGGGACAGAGTCGTCACCAAGTCCACCCGAACCTGGGTGCTGCCCAGCTACAACAACCACCAGTACCGAGAGATCAAAAGCGGCTCCGTCGACGGAAGCAACGCCAACGCCTACTTTGGATACAGCACCCCCTGGGGGTACTTTGACTTTAACCGCTTCCACAGCCACTGGAGCCCCCGAGACTGGCAAAGACTCATCAACAACTACTGGGGCTTCAGACCCCGGTCCCTCAGAGTCAAAATCTTCAACATTCAAGTCAAAGAGGTCACGGTGCAGGACTCCACCACCACCATCGCCAACAACCTCACCTCCACCGTCCAAGTGTTTACGGACGACGACTACCAGCTGCCCTACGTCGTCGGCAACGGGACCGAGGGATGCCTGCCGGCCTTCCCTCCGCAGGTCTTTACGCTGCCGCAGTACGGTTACGCGACGCTGAACCGCGACAACACAGAAAATCCCACCGAGAGGAGCAGCTTCTTCTGCCTAGAGTACTTTCCCAGCAAGATGCTGAGAACGGGCAACAACTTTGAGTTTACCTACAACTTTGAGGAGGTGCCCTTCCACTCCAGCTTCGCTCCCAGTCAGAACCTGTTCAAGCTGGCCAACCCGCTGGTGGACCAGTACTTGTACCGCTTCGTGAGCACAAATAACACTGGCGGAGTCCAGTTCAACAAGAACCTGGCCGGGAGATACGCCAACACCTACAAAAACTGGTTCCCGGGGCCCATGGGCCGAACCCAGGGCTGGAACCTGGGCTCCGGGGTCAACCGCGCCAGTGTCAGCGCCTTCGCCACGACCAATAGGATGGAGCTCGAGGGCGCGAGTTACCAGGTGCCCCCGCAGCCGAACGGCATGACCAACAACCTCCAGGGCAGCAACACCTATGCCCTGGAGAACACTATGATCTTCAACAGCCAGCCGGCGAACCCGGGCACCACCGCCACGTACCTCGAGGGCAACATGCTCATCACCAGCGAGAGCGAGACGCAGCCGGTGAACCGCGTGGCGTACAACGTCGGCGGGCAGATGGCCACCAACAACCAGAGCTCCACCACTGCCCCCGCGACCGGCACGTACAACCTCCAGGAAATCGTGCCCGGCAGCGTGTGGATGGAGAGGGACGTGTACCTCCAAGGACCCATCTGGGCCAAGATCCCAGAGACGGGGGCGCACTTTCACCCCTCTCCGGCCATGGGCGGATTCGGACTCAAACACCCACCGCCCATGATGCTCATCAAGAACACGCCTGTGCCCGGAAATATCACCAGCTTCTCGGACGTGCCCGTCAGCAGCTTCATCACCCAGTACAGCACCGGGCAGGTCACCGTGGAGATGGAGTGGGAGCTCAAGAAGGAAAACTCCAAGAGGTGGAACCCAGAGATCCAGTACACAAACAACTACAACGACCCCCAGTTTGTGGACTTTGCCCCGGACAGCACCGGGGAATACAGAACCACCAGACCTATCGGAACCCGATACCTTACCCGACCCCTTTAA

SEQ ID NO: 5116 - DNA, 2208 bp, Adeno-associated virus 6
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 5117 - protein, 736 aa, Adeno-associated virus 6; identical to SEQ ID NO: 4762

SEQ ID NO: 5118 - protein, 623 aa, Adeno-associated virus 6
MPGFYEIVIKVPSDLDEHLPGISDSFVNWVAEKEWELPPDSDMDLNLIEQAPLTVAEKLQRDFLVQWRRVSKAPEALFFVQFEKGESYFHLHILVETTGVKSMVLGRFLSQIRDKLVQTIYRGIEPTLPNWFAVTKTRNGAGGGNKVVDECYIPNYLLPKTQPELQWAWTNMEEYISACLNLAERKRLVAHDLTHVSQTQEQNKENLNPNSDAPVIRSKTSARYMELVGWLVDRGITSEKQWIQEDQASYISFNAASNSRSQIKAALDNAGKIMALTKSAPDYLVGPAPPADIKTNRIYRILELNGYDPAYAGSVFLGWAQKRFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWAQDHVTEVAHEFYVRKGGANKRPAPDDADKSEPKRACPSVADPSTSDAEGAPVDFADRYQNKCSRHAGMLQMLFPCKTCERMNQNFNICFTHGTRDCSECFPGVSESQPVVRKRTYRKLCAIHHLLGRAPEIACSACDLVNVDLDDCVSEQ

SEQ ID NO: 5119 - DNA, 4683 bp, Adeno-associated virus 6
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagcgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgacttcctggtccagtggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttaaacctggccgagcgcaaacggctcgtggcgcacgacctgacccacgtcagccagacccaggagcagaacaaggagaatctgaaccccaattctgacgcgcctgtcatccggtcaaaaacctccgcacgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctccgcccgccgacattaaaaccaaccgcatttaccgcatcctggagctgaacggctacgaccctgcctacgccggctccgtctttctcggctgggcccagaaaaggttcggaaaacgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggatctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttaattcgtgtcagttgaactttggtctcatgtcgttattatcttatctggtcaccatagcaaccggttacacattaactgcttagttgcgcttcgcgaatacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 5120 - DNA, 2211 bp, Adeno-associated virus 6
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5121 - DNA, 2214 bp, Adeno-associated virus 7
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaa

SEQ ID NO: 5122 - protein, 738 aa, Adeno-associated virus 7
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5123 - protein, 737 aa, Adeno-associated virus 7
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 5124 - protein, 623 aa, Adeno-associated virus 7
MPGFYEIVIKVPSDLDEHLPGISDSFVNWVAEKEWELPPDSDMDLNLIEQAPLTVAEKLQRDFLVQWRRVSKAPEALFFVQFEKGESYFHLHVLVETTGVKSMVLGRFLSQIREKLVQTIYRGVEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPADIKTNRIYRILELNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADISEPKRACPSVADPSTSDAEGAPVDFADRYQNKCSRHAGMIQMLFPCKTCERMNQNFNICFTHGVRDCLECFPGVSESQPVVRKKTYRKLCAIHHLLGRAPEIACSACDLVNVDLDDCVSEQ

SEQ ID NO: 5125 - DNA, 4721 bp, Adeno-associated virus 7
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 5126 - DNA, 2214 bp, Adeno-associated virus 7; identical to SEQ ID NO: 5121

SEQ ID NO: 5127 - protein, 737 aa, Adeno-associated virus 7; identical to SEQ ID NO: 5123

SEQ ID NO: 5128 - DNA, 2217 bp, Adeno-associated virus 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5129 - DNA, 2213 bp, Adeno-associated virus 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgtaatacagaaggcgtgtactctgaaccccgccccattggcacccgttacctcacccgtaatctg

SEQ ID NO: 5130 - DNA, 4393 bp, Adeno-associated virus 8
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 5131 - protein, 738 aa, Adeno-associated virus 8; identical to SEQ ID NO: 5122

SEQ ID NO: 5132 - protein, 737 aa, Adeno-associated virus 8
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVIQKACTLNPAPLAPVTSPVI

SEQ ID NO: 5133 - DNA, 2217 bp, Adeno-associated virus 8; identical to SEQ ID NO: 5128

SEQ ID NO: 5134 - DNA, 4385 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacggcaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccaaaggtgtttactctgagcctcgccccattggtactcgttacctcacccgtaatttgtaattgcctgttaatcaataaaccggttaattcgtttcagttgaactttggtctctgcg

SEQ ID NO: 5135 - DNA, 4382 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgtagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccccaagaaccagactcatcctcgggcatcggcaaatcaggccagcagcccgctaaaaagagactcaattttggtcagactggcgactcagagtcagtccccgacccacaacctctcggagaacctccagaagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccgaaggtgtttactctgagcctcgccccattggtactcgttacctcacccgtaatttgtaattgcctgttaatcaataaaccggttaattcgtttcagttgaactttggtctctgcg

SEQ ID NO: 5136 - protein, 736 aa, Adeno-associated virus 9; identical to SEQ ID NO: 4768

SEQ ID NO: 5137 - protein, 736 aa, Adeno-associated virus 9
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKSGQQPAKKRLNFGQTGDSESVPDPQPLGEPPEAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5138 - protein, 623 aa, Adeno-associated virus 9
MPGFYEIVIKVPSDLDEHLPGISDSFVNWVAEKEWELPPDSDMDRNLIEQAPLTVAEKLQRDFLVQWRRVSKAPEALFFVQFEKGESYFHLHVLVETTGVKSMVLGRFLSQIREKLVQTIYRGIEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPVDITQNRIYRILQLNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADKSEPKRACPSVADPSTSDAEGAPVDFADRYQNKCSRHAGMLQMLLPCKTCERMNQNFNICFTHGVRDCSECFPGVSESQPVVRKRTYRKLCAIHHLLGRAPEIACSACDLVNVDLDDCVSEQ

SEQ ID NO: 5139 - DNA, 1797 bp, Artificial Sequence
  Description of Artificial Sequence: Synthetic polynucleotide
acggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 5140 - DNA, 1989 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 5141 - DNA, 1626 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 5142 - DNA, 1323 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 5143 - DNA, 960 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 5144 - DNA, 1608 bp, Artificial Sequence
  Description of Artificial Sequence: Synthetic polynucleotide
atggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 5145 - DNA, 2232 bp, Artificial Sequence
  Description of Artificial Sequence: Synthetic polynucleotide
atgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 5146 - protein, 535 aa, Artificial Sequence
  Description of Artificial Sequence: Synthetic polypeptide
MAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 5147 - protein, 440 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 5148 - protein, 319 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 5149 - protein, 662 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 5150 - protein, 541 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 5151 - protein, 743 aa, Artificial Sequence
  Description of Artificial Sequence: Synthetic polypeptide
MSLISDAIPDWLERLVKKGVNAAADFYHLESGPPRPKANQQTQESLEKDDSRGLVFPGYNYLGPFNGLDKGEPVNEADAAALEHDKAYDLEIKDGHNPYFEYNEADRRFQERLKDDTSFGGNLGKAIFQAKKRVLEPFGLVEDSKTAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 5152 - protein, 598 aa, Artificial Sequence
  Description of Artificial Sequence: Synthetic polypeptide
TAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 5153 - DNA, 4694 bp, Artificial Sequence
  Description of Artificial Sequence: Synthetic polynucleotide
tggccagtttccaagacaggctcgctcgctcactcgggccggggccccaaaggggcccctagcgaccgcttcgcggtcgcggcccgagtgagcgagcgagcctgtcttggaaactggccagcactccggtgaggtaatgccgtcacgtggtcgggaatgggaacgggaaatctcgcgagaacgtaaacaaatataagacggcgccacacggcgctgcgtcatacgcgcgcgcgcaccggcgagatgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataaatgattgaaatgtagccatgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaaattaaacccttcaataaaccgtttatgcgtaactgtatttccgtctcctgtcgttattcagtcacatgatgcggcattacctcaccggagtgctggccagtttccaagacaggctcgctcgctcactcgggccggggccccaaaggggcccctagcgaccgcttcgcggtcgcggcccgagtgagcgagcgagcctgtcttggaaactggcca

SEQ ID NO: 5154 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5155 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5156 - DNA, 2211 bp, Artificial Sequence
  Description of Artificial Sequence: Synthetic polynucleotide
atggcttccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcagagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattctactggccaagtcagcgtggagattgaatgggagctgcagaaagaaaacagcaaacgctggaatcccgaagtgcagtatacatctaactatgcaaaatctgccaacgttgatttcactgtggacaacaatggactttatactgagcctcgtcccattggcacccgttacctcacccgtcccctgtaa

SEQ ID NO: 5157 - protein, 736 aa, Artificial Sequence
  Description of Artificial Sequence: Synthetic polypeptide
MASDGYLPDWLEDNLSEGIREWWDLKPGAPKPKANQQKQDDGRGLVLPGYKYLGPFNGLDKGEPVNAADAAALEHDKAYDQQLRAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5158 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5159 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5160 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcaatcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacataaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaaacgctggaatcccgaagtgcagtatacatctaactatgcaaaatctgccaacattgatttcactgtggacaacaatggactttatactgagcctcgccccattggcacccgttacctcacccgtccccagtaa

SEQ ID NO: 5161 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANIDFTVDNNGLYTEPRPIGTRYLTRPQ

SEQ ID NO: 5162 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtaccttcggtataaccacgccgacgccgagtttcaggagcgtctgcaagaagatacgtcttttgggggcaacctcgggcgagcagtcttccaggccaaaaagagggttctcgaacctctcggtctggttgaggaagcggctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctcccgcagccccctcaggtgtgggatctcttacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagtgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 5163 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEQSPQEPDSSSGIGKTGQQPAKKRLNFGQTGDSESVPDPQPLGEPPAAPSGVGSLTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQCVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5164 - DNA, 2211 bp, Artificial Sequence
  Description of Artificial Sequence: Synthetic polynucleotide
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttaccttcagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5165 - protein, 736 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5166 - DNA, 2208 bp, Artificial Sequence
  Description of Artificial Sequence: Synthetic polynucleotide
  modified_base (955)..(955): n is a, c, t or g
  misc_feature (955)..(955): n is a, c, g, or t
  modified_base (971)..(972): n is a, c, t or g
  misc_feature (971)..(972): n is a, c, g, or t
  modified_base (981)..(981): n is a, c, t or g
  misc_feature (981)..(981): n is a, c, g, or t
  modified_base (986)..(986): n is a, c, t or g
  misc_feature (986)..(986): n is a, c, g, or t
  modified_base (1235)..(1235): n is a, c, t or g
  misc_feature (1235)..(1235): n is a, c, g, or t
  modified_base (1694)..(1696): n is a, c, t or g
  misc_feature (1694)..(1696): n is a, c, g, or t
  modified_base (1698)..(1698): n is a, c, t or g
  misc_feature (1698)..(1698): n is a, c, g, or t
  modified_base (1763)..(1765): n is a, c, t or g
  misc_feature (1763)..(1765): n is a, c, g, or t
  modified_base (1778)..(1778): n is a, c, t or g
  misc_feature (1778)..(1778): n is a, c, g, or t
  modified_base (2204)..(2204): n is a, c, t or g
  misc_feature (2204)..(2204): n is a, c, g, or t
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcaataacaattggggattccggcccaagagactcaacttcaaactcttcaacntccaagtcaaggaggnnacgacgaangatgncgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttacctncagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagagannncnaagccactaaccccgtggccactgaaagatttgggactgtggcagtcaatctccaagcagcacannnaccctgcgaccgnagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtccccngtaa

SEQ ID NO: 5167 - protein, 723 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNQVKETTDVTTIANNLTSTVQVFSDSEYQLPYVLGSAHQGCLPPFPADVFMIPQYGYLTLNNGSQAVGRSSFYCLEYFPSQMLRTGNNFTSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEATNPVATERFGTVAVNLQSSPATDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5168 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggtcagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacgctccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 5169 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDAPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 5170 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcaaactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcgggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacgaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtatacagagcctcgccccattggcaccagatacctgactcgtaatctgtaa

SEQ ID NO: 5171 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDANSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSRAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYTEPRPIGTRYLTRNL

SEQ ID NO: 5172 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaataactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcactcaatactccacaggacaagtgagcgtggaaattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5173 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5174 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRNQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNQ

SEQ ID NO: 5175 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggaacgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcggaaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatcagtaa

SEQ ID NO: 5176 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgatccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtatgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 5177 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 5178 - DNA, 2172 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctt

SEQ ID NO: 5179 - DNA, 2214 bp, Artificial Sequence
  Description of Artificial Sequence: Synthetic polypeptide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcctgagcggacggcgatgagtcttccgggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 5180 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLPERTAMSLPGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5181 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgagttttagtcgtgcggttctttgtgatggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 5182 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLSFSRAVLCDGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5183 - DNA, 2215 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcactctcctgtggagccagactcctcctcgggaaccggaaaggcgggccagcagcctgcaagaaaaagattgaattttggtcagactggagacgcagactcagtcccagaccctcaaccaatcggagaacctcccgcagccccctcaggtgtgggatctcttacaatggctgcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagtttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacctgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5184 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5185 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5186 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5187 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5188 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 5189 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5190 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5191 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 5192 - protein, 736 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 5193 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 5194 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5195 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcccctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5196 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5197 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatgactgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5198 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 5199 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgccttttcacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5200 - protein, 737 aa, Artificial Sequence; identical to SEQ ID NO: 5188
  Description of Artificial Sequence: Synthetic polypeptide

SEQ ID NO: 5201 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 5202 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5203 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttccgggttacaaatacctcggacccggtaacggactcgacaaaggagagccggtcaacgaggcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcccggaaagaaacgtccggtagagcagtcgccacaagagccagactcctctacgggcatcggcaagaaaggccaacagcccgccagaaaaagactcaatttcggtcagactggcgactcagagtcagttccagaccctcaacctctcggagaacctccagcagcgccctctggtgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaacacctacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5204 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPGNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPARKRLNFGQTGDSESVPDPQPLGEPPAAPSGVGPTTMASGGGAPMADNNEGADGVGNASGNWHCDSTWLGDRVITTSTRTWALPTYNNHLYKQISSASTGASNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5205 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5206 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPADPPTTFNQSKLNSFITQYSTGQVSVEIEWELQKENSKRWNPEVQYTSNYAKSANVDFTVDNNGLYTEPRPIGTRYLTRPL

SEQ ID NO: 5207 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagtgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaggagagcgccggagcttcaaacactgcattggacaatgtcatgatcaccgacgaagaggaaatcaaagccactaaccccgtggccaccgaaagatttgggactgtggcagtcaatctccagagcagcagcacagaccctgcgaccggagatgtgcatgttatgggagccttacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5208 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKWVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5209 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctcggcgcaccagggctgcctccctccgttcccggcggacgtcttcatggtgccacagtatggatacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggacttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5210 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMVPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGDLPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 5211 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaactgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttaccaaacctctgtaa

SEQ ID NO: 5212 - protein, 734 aa, Artificial Sequence
  Description of Artificial Sequence: Synthetic polypeptide
MAADGYLPDWLEDNLSEGIREWWALKPGVPQPKANQQHQDNCRGLVLPGYKYLGPGNGLDKGEPVNEADAAALEHDKAYDQQLKAGDNPYLKYNHADAEFQERLKEDTSFGGNLGRAVFQTKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTKPL

SEQ ID NO: 5213 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 5214 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5215 - DNA, 2214 bp, Artificial Sequence; identical to SEQ ID NO: 5187
  Description of Artificial Sequence: Synthetic polynucleotide

SEQ ID NO: 5216 - protein, 737 aa, Artificial Sequence; identical to SEQ ID NO: 5188
  Description of Artificial Sequence: Synthetic polypeptide

SEQ ID NO: 5217 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaaacacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5218 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTSVDFAVNTEGVYSEPRPIGTRYLTRNL

SEQ ID NO: 5219 - DNA, 2217 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccctctcccctcatgggtggattcggacttaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5220 - protein, 738 aa, Artificial Sequence; identical to SEQ ID NO: 5122
  Description of Artificial Sequence: Synthetic polypeptide

SEQ ID NO: 5221 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaggtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 5222 - protein, 736 aa, Artificial Sequence; identical to SEQ ID NO: 5192
  Description of Artificial Sequence: Synthetic polypeptide

SEQ ID NO: 5223 - DNA, 2211 bp, Artificial Sequence; identical to SEQ ID NO: 5191
  Description of Artificial Sequence: Synthetic polynucleotide

SEQ ID NO: 5224 - protein, 736 aa, Artificial Sequence; identical to SEQ ID NO: 5192
  Description of Artificial Sequence: Synthetic polypeptide

SEQ ID NO: 5225 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5226 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5227 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcaacggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5228 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADATALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 5229 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaacaaccacctctacaaacaaatttccagccaatcaggagcctcgaacgacaatcactactttggctacagcaccccttgggggtattttgatttcaacagattccactgccacttttcaccacgtgactggcagcgactcatcaacaacaattggggattccggcccaagagactcagcttcaagctcttcaacatccaggtcaaggaggtcacgcagaatgaaggcaccaagaccatcgccaataaccttaccagcacggttcaagtgtttacggactcggagtatcagctcccgtacgtgctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctgattgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggactatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccgtctccgctgatgggcggctttggcctgaaacatcctccgcctcagatcctgatcaagaacacgcctgtacctgcggatcctccgaccaccttcaaccagtcaaagctgaactctttcatcactcagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5230 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDYEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5231 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgatttcaacagattccactgccatttctcaccacgtgactggcagcgactcatcaacaacaattggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatttgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacccgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5232 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDADSVPDPQPLGQPPAAPSGLGTNTMATGSGAPMADNNEGADGVGNSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTFADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5233 - DNA, 2217 bp, Artificial Sequence
  Description of Artificial Sequence: Synthetic polynucleotide
atggctgccgatggttatcttccagattggctcgaggacactctctctgaaggaataagacagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5234 - protein, 738 aa, Artificial Sequence
  Description of Artificial Sequence: Synthetic polypeptide
MAADGYLPDWLEDTLSEGIRQWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 5235 - DNA, 2208 bp, Artificial Sequence; identical to SEQ ID NO: 5065
  Description of Artificial Sequence: Synthetic polynucleotide

SEQ ID NO: 5236 - protein, 735 aa, Artificial Sequence [sequence omitted]

SEQ ID NO: 5237 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgccgcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcagctaaaacggctcctggaaagaagaggcctgtagagcagtctcctcaggaaccggactcctccgcgggtattggcaaatcgggtgcacagcccgccaaaaagagactcaatttcggtcagactggcgactcagagtcagtcccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacagcaaccatctctacaagcaaatctccagccaatcaggagcttcaaacgacaacgactactttggctacagcaccccttgggggtattttgatttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgaggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 5238 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPAAPTSLGSNTMASGGGAPMADNNEGADGVGNASGNWHCDSTWLGDRVITTSTRTWALPTYSNHLYKQISSQSGASNDNDYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSEDNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 5239 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagttccaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtcccagaccctcaacctctcggagaaccaccagcagcccccacaagtttgggatctaatacaatggcttcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcttcaaacgacaaccactactttggctacagcaccccttgggggtattttgactttaacagattccactgccacttttcaccacgtgactggcagcgactcattaacaacaactggggattccggcccaagaaactcaacttcaagctctttaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtattacttgtctcggactcaaacaacaggaggcacgacaaatacgcagactctgggcttcagccaaggtgggcctaatacaatggccaatcaggcaaagaactggctgcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggttatgattacagacgaagaggaaatcaggacaaccaatcccgtggctacggagcagtatggttctgtatctaccaacctccagagaggcaacagacaagcagctaccgcagatgtcaacacacagggcgttcttccaggcatggtctggcaggacagagatgtgtaccttcagggtcccatttgggccaaaattcctcacacagatggacactttcacccgtcccctcttatgggcggctttggactcaagaacccgcctcctcagatcctcatcaaaaacacgcctgttcctgcgaatcctccggcagagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacactaatggcgtgtattcagagcctcgccccattggcaccagatacctcacccgtaatctgtaa

SEQ ID NO: 5240 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKKLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDTNGVYSEPRPIGTRYLTRNL

SEQ ID NO: 5241 - DNA, 2214 bp, Artificial Sequence; identical to SEQ ID NO: 5231
  Description of Artificial Sequence: Synthetic polynucleotide

SEQ ID NO: 5242 - protein, 737 aa, Artificial Sequence; identical to SEQ ID NO: 5232
  Description of Artificial Sequence: Synthetic polypeptide

SEQ ID NO: 5243 - protein, 736 aa, Artificial Sequence; identical to SEQ ID NO: 5056
  Description of Artificial Sequence: Synthetic polypeptide

SEQ ID NO: 5244 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQRANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5245 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDAFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5246 - protein, 538 aa, Artificial Sequence
  Description of Artificial Sequence: Synthetic polypeptide
MRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5247 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVHIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTNKNFSGYRKNWLPGPMMKQQRFSKTASQNYKIPQGGNNSLLHYETRTTLDRRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5248 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5249 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataaccttaccagcacggtccaggtcttcacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 5250 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 5251 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 5252 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLQGDTSFGGNLGRAVFQAKKRVLEPLGLVEEGAKTAPGKKRPVEQSPQEPDSSSGIGETGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 5253 - DNA, 2181 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcacaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgcacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactattggggcttcagaccccggtctctcagagtcaaaatcttcaacatccaagtcaaagaggtcacggtgcaggactccaccaccaccatcgccaacaacctcacctccaccgtccaagtgtttacggacgacgactaccaactcccgtacgtcgtcggcaacgggaccgagggatgcctgccggccttccccccgcaggtctttacgctgccgcagtacggctacgcgacgctgaaccgagacaacggagacaacccgacagagcggagcagcttcttttgcctagagtactttcccagcaagatgctgaggacgggcaacaactttgagtttacctacagctttgaagaggtgcccttccactgcagcttcgccccgagccagaacctctttaagctggccaacccgctggtggaccagtacctgtaccgcttcgtgagcacctcggccacgggcgccatccagttccaaaagaacctggcgggcagatacgccaacacctacaaaaactggttcccggggcccatgggccgaacccagggctggaacacgagctctggggtcagcagcaccaacagagtcagcgtcaacaacttttccgtctcaaaccggatgaacctggagggggccagctaccaagtgaacccccagcccaacgggatgacaaacacgctccaaggcagcaaccgctacgcgctggaaaacaccatgatcttcaacgctcaaaacgccacgccgggaactacctcggtgtacccagaggacaatctactgctgaccagcgagagcgagactcagcccgtcaaccgggtggcttacaacacgggcggtcagatggccaccaacgcccagaacgccaccacggctcccacggtcgggacctacaacctccaggaagtgcttcctggcagcgtatggatggagagggacgtgtacctccaaggacccatctgggccaagatcccagagacgggggcgcactttcacccctctccggccatgggcggattcggactcaaacacccgccgcccatgatgctcatcaaaaacacgccggtgcccggcaacatcaccagcttctcggacgtgcccgtcagcagcttcatcacccagtacagcaccgggcaggtcaccgtggagatggaatgggagctcaaaaaggaaaactccaagaggtggaacccagagatccagtacaccaacaactacaacgacccccagtttgtggactttgctccagacggctccggcgaatacagaaccaccagagccatcggaacccgatacctcacccgacccctt

SEQ ID NO: 5254 - protein, 726 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNGDNPTERSSFFCLEYFPSKMLRTGNNFEFTYSFEEVPFHCSFAPSQNLFKLANPLVDQYLYRFVSTSATGAIQFQKNLAGRYANTYKNWFPGPMGRTQGWNTSSGSSTNRVSVNNFSVSNRMNLEGASYQVNPQPNGMTNTLQGSNRYALENTMIFNAQNATPGTTSVYPEDNLLLTSESETQPVNRVAYNTGGQMATNAQNATTAPTVGTYNLQEVLPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDGSGEYRTTRAIGTRYLTRPL

SEQ ID NO: 5255 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKSGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 5256 - DNA, 1803 bp, Bovine adeno-associated virus
acggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 5257 - DNA, 1617 bp, Bovine adeno-associated virus
atgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 5258 - DNA, 1173 bp, Bovine adeno-associated virus
atggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 5259 - DNA, 1833 bp, Bovine adeno-associated virus
atggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 5260 - DNA, 2211 bp, Bovine adeno-associated virus
atgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 5261 - DNA, 4694 bp, Bovine adeno-associated virus
gtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccacactctctagcaagggggttttgtaggtggtgatgtcattgttgatgtcattatagttgtcacgcgatagttaatgattaacagtcatgtgatgtgtgttatccaataggatgaaagcgcgcgaatgagatctcgcgagacttccggggtataaaaggggtgagtgaacgagcccgccgccattctctgctctggactgctagaggaccctcgctgccatggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaaataaagtgagtagtcatgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctagcccaattctgttgcataccctcaataaaccgtgtattcgtttcagtaaaatactgcctcttgtggtcattcggcgtacaacagcttacaacaacaacaaaacccccttgctagagagtgtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccac

SEQ ID NO: 5262 - protein, 390 aa, Bovine adeno-associated virus
MALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 5263 - protein, 610 aa, Bovine adeno-associated virus
MATFYEVIVRVPFDVEEHLPGISDNFVDWVTGQIWELPPESDLNLTLIEQPQLTVADRIRRVFLYEWNKFSKQESKFFVQFEKGSEYFHLHTLVETSGISSMVLGRYVSQIRAQLVKVVFQNIEPRINDWVAITKVKKGGANKVVDSGYIPAYLLPKVQPELQWAWTNLEEYKLAALNLEERKRLVAQFQLESSQRSQEASSQRDVSADPVIKSKTSQKYMALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 5264 - protein, 736 aa, Bovine adeno-associated virus; identical to SEQ ID NO: 5248

SEQ ID NO: 5265 - protein, 600 aa, Bovine adeno-associated virus
TAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5266 - DNA, 17746 bp, Homo sapiens
gattaagggctctggccggctgtacccacgcccccgccctggcctgggctggcaaggaagacctgtgggcgggcgtcaaaagggggaccggccctgtgacccctcaccgggggccgtgggcccgagcccccggacttccctgtaaatgtcagaggcccctccgctgggatagggtcggtctgagggcgcaggcgagtccctgctgacccctgacgcctccgacggggggaggggcaggccgggtgggagcgggaagccggggcggcagaagggggcttcggggcggtgtccttggccccagttagtcttcccagcctccggagggggcggtagcagcagaatcatcccatgggttactcgggcttggagaaactcggggttacggggagaaccctaggggaggccggggtctcagtcgctcagcctgctccgtctgtgttcgcagaagccggcaatgaccgcctgcgcccgccgagcgggtgggcttccggaccccgggctctgcggtcccgcgtggtgggctccgtccctgccccgcctcccccgggccctgccccggctcccgctcctgctgctcctgcttctgctgcagccccccgccctctccgccgtgttcacggtgggggtcctgggcccctgggcttgcgaccccatcttctctcgggctcgcccggacctggccgcccgcctggccgccgcccgcctgaaccgcgaccccggcctggcaggcggtccccgcttcgaggtagcgctgctgcccgagccttgccggacgccgggctcgctgggggccgtgtcctccgcgctggcccgcgtgtcgggcctcgtgggtccggtgaaccctgcggcctgccggccagccgagctgctcgccgaagaagccgggatcgcgctggtgccctggggctgcccctggacgcaggcggagggcaccacggcccctgccgtgacccccgccgcggatgccctctacgccctgcttcgcgcattcggctgggcgcgcgtggccctggtcaccgccccccaggacctgtgggtggaggcgggacgctcactgtccacggcactcagggcccggggcctgcctgtcgcctccgtgacttccatggagcccttggacctgtctggagcccgggaggccctgaggaaggttcgggacgggcccagggtcacaggtaggctcccttgcagggtgcgaggaggtcggctggtcctgccggcagccggacggcgccgcgagccaagcctctgtccgcagcagtgatcatggtgatgcactcggtgctgctgggtggcgaggagcagcgctacctcctggaggccgcagaggagctgggcctgaccgatggctccctggtcttcctgcccttcgacacgatccactacgccttgtccccaggcccggaggccttggccgcactcgccaacagctcccagcttcgcagggcccacgatgccgtgctcaccctcacgcgccactgtccctctgaaggcagcgtgctggacagcctgcgcagggctcaagagcgccgcgagctgccctctgacctcaatctgcagcaggtagacggtcccgggaggagggaagaaggcaagggagaggggagaggacagccaaagcagggagaggaggatgcagccaatggagaaagaaccactggcagctctagctgtttggagtttcctgggtaatgtagaggctctggccccacttggggtctcttagtgtacgaggattgcctctagagagtaggcaattcgacctctcaagtccaacatcaagcagtaaactctaatgaactgtaaactgcaaaaccttttgcaattggcttcaaagtaaacccgtttccaccaccacatactcccagctgtctaaaataaatacttggtgttcttgaaagcaggaaggagggaggatgccaatccaaccttcatccctagttcagaggtatttcctctggggcctcatctggtggtcttagcttttcaagggcctagacaccttgcaagaagcagaaagttccctgggtggattcaggggcaatcctaaccagatccatagtgtatttccaacatccagctaatacctagggatccccaagtccccagaatcccagttcagatcatctaactttactcccgccacaaagggggactagaaaccactatgagaagggaatttagatgtcaacgggcagtgaattaaccaccacaaaggtccaactcacaggcggctgcatgagagaagggtcgtaggggttgcaatttcccatcgatgcccctagattcttccaagaggattggaggtgtccaatggaggggggaggggtgcagtgatgggaatagtcagaagagaatacaagataggaatcataatgagatgggatggagggagggtcggtcagtggagagagggaggttgagaaagtagagagagaaaagcccttcagctctcagtaagtaccacagcagtcctctccactgcccaaactgcgcaagcctctgagcgtgtgagtcacccttgattccttgaattcttcgcccccacttccaggcatcaagccctgttactgttacttcctaaagatcattcgaattcatccgctttctccatctttactgtcactgccctgattcaggccacagcacccccagcccaaatcccaaaacataatctctcagatggtctctgcttcaacactcacctgcccaacacctttctccagatcaagcttcagaaatctgacagatctcaccctgtcatgcccctgttcaaagcctcacagtggcttctgttgccctggatagatgcaggcctctccacatggcttaccaggtcacctgtctttctctctcttccacctcccatgaacttcagccagaccaagctactctgggttcttggaatgtgtccttctcttttgcctctgagcttctgagtgtgctgtttcctctctcttgtccctgcctcccctggataattctgactcatcccctgaaggatggtcacttctaacagctccttctctgtccacagcctagggtggggacacccattcctgtctctgcagctccctcagtttcccctacttttactcattgcactgcctgaacacccctgtctctttggcaagaagaaaggttccttgagacggggtctgtcttgtacactgatacatctttagtgctctgcacagtgcctggctctctgagagatggcaactgggaataatagagaagcctgataagatcgggtggtaacaatagagaaggttttttgtttgttttttgtttagtttttttgtttgtttgtttgtttttttaaggaacaacagaaaatagaagccaaccaaaagataggtgagaaggcttttaggtgaatggtaggtgatgaggttaaaactatatgctgggcaaccaacaggaagaagagaggacctacaggtgatggagaattagaatcaaccaatggtcagagaggaggctgagtcctgaaaagaggaaccagttagtggggagagcaggtgtgacagccaataggagagggaggaagagagagccagtggggagggaggaagagagagccaatggggagggaggaagagagccaatggggagggaggaagagatagccaatggggagggatcctgggaacaactaactggaaggtggcaacagtggataccctgggcttgacaggcagtgaaagaatctggtctgtctgtgggctgtgaccccgacctctgagcccctactctccttctccaggtctccccactctttggcaccatctatgacgcggtcttcttgctggcaaggggcgtggcagaagcgcgggctgccgcaggtggcagatgggtgtccggagcagctgtggcccgccacatccgggatgcgcaggtccctggcttctgcggggacctaggaggagacgaggagcccccattcgtgctgctagacacggacgcggcgggagaccggctttttgccacatacatgctggatcctgcccggggctccttcctctccgccggtacccggatgcacttcccgcgtgggggatcagcacccggacctgacccctcgtgctggttcgatccaaacaacatctgcggtggaggtgagggcgagcaccccagtccccactgagacaatcgccatggaccatccacaaagtgatgaaagagagtggactcctatcctgtaatccgtcttcgatgcccttctaggccctctcccagcctctggcttgcacaggacccctctcttgctgagctccaaagccctcttggaaattttctatcattcccagcctctcccctttgaggaactatgacctacccctagagcctctctgggcccccatccccctttcctggaggggccagcatgtggcatgcctccctagagaagaggcctcccctggcatcgctcctcagtatacctcctgtcactgtcccttcaggactggagccgggcctcgtctttcttggcttcctcctggtggttgggatggggctggctggggccttcctggcccattatgtgaggtgagtagtggaatgaggtaagtaggaagtgagcttgtgccagaaatggaagtctgcagcaaaaacagcaggctgggttcactcaggagtagaggaggagatttttcttggggtgagggtgttctggtgggctggtagagtcccaggggatgtgtgctttggggatggctgccctccaggacccctcccctgagccaacgttatccctcccccgcatcccctgctggtctcttctgacggaacttggtgcccttggtggaggtgacctctttctccaccaggcaccggctacttcacatgcaaatggtctccggccccaacaagatcatcctgaccgtggacgacatcacctttctccacccacatgggggcacctctcgaaaggtgggggaggcagagaggcaggagccagttgtcttctttccgtaaatttggttccttccctgggccagtcccgaccccagctccctacttgggaagcctgatttctaccccagttctgtcccacgtctgaagtctagggatcagcaccctcatctgtgcaatgagggtaacagtacctgtcctgactactttcctggcggggaggtgaagctccaacaagaaaatgaatgtttgctttgtaaactgtaaagcgtgcacttggggagtaatgtcattatcaccttccctcattgagattccttcgcctcccatctttaaatccccaaaactcagcctgacctcaacccaggactctgacaccagaatatattttgacctcttgcattgacctctacctgctaggtggcccaggggagtcgatcaagtctgggtgcccgcagcatgtcagacattcgcagcggccccagccaacacttggacagccccaacattggtgtctatgaggtgagcctgaccccagccagacagagagacagtgggggaagaatgctcaggccctgggcagaggggaggcgcactctcaggaggacatgtagtcatgtcaaatcctgcaggctccaggagatgggggatgggagcccagacaggatctagggaaaggtcatggatccctcaaagggaagcacctaggaatcttccctccccaaggatttttctctagccactatctgggtaagggctcctcaaaagctaaccacagtgacccagagactggaggctggagctgccagggagcatgctgggaccagcaggtaacatggtgtggccactgagaccatctccggcctggtcagagcctctggccctgcccctcagcatttccacccaattcagaccagactcaggaatagcaacccctagagggggaaaagaaagtcacaaaaaagtattaggacattaactttggggctggtaaatctgaatgcggtcaagtggaggggagatgatgagaacagattgagagagagctgagagtgctgagcaaatcaagagagtagaaatttagagctcctgggcttcaggtcatgggaaggaatgcagaggctcctatcatgtcacctagagatcatcatggccaattctcagaggaggcactattgtcatttggggcagattgtcctaaattgtatgggactactctgtgccttgaagaatatttagtgtttcttgtctctggccctgtccactaatgcagctcctagtttttgtgacagttaaaactttccccacatttatttccaaatgctccttaggggtcagtactaaaccccaattcccttctaaattcccttctagtccaaatcccttataaacaagacagggccacctgcataattagcgagatccagggcaagatagaaatgaggggctcctcgttcattcatgatgatggcaggaggtcattgaaccaagcttgggcccttcggagcacgaggccctgtgtgactgcacaggtcccatgcctgtgaaccggccctgccaacagttgaggatgaggtccagcatcaggaggggagctgtctatagttcagttagttttcaataaagcctgatctacccagattttttactcccagaacatgttctctcatggcagtggatggtaatgagggttgtgatgtcgatgacacttgtggttgtattaatgcacttaataggactattggtgggcacagctgggttggtgaggacagccatccatggcttcagaatctctgtcatccaggggtgggccctctcccagatggctgtgaagtggatgggcatacatcaaaccccttggttcaatgcattttgtcacatggaagatgcattctgggacagtgagccaatggaaatgagggggaggggttctagggctccccatcgtgggattttaagagactgagttccctacccccatcctctttgctgcagggagacagggtttggctgaagaaattcccaggggatcagcacatagctatccgcccagcaaccaagacggccttctccaaggtgagacttgggcctgtgatggggcctaggtggccatcggtttctccctccttgccttctctttgcagctgggtacagaggtaggtctcagttaagtgtcccctctggctgagtgtggtggctcatacgtgtaatcctggcactttgagaggcagatgtgagggaggatcacctgaggccaggagttcaagaccagcctgggcaacataaagaaaccctatctctccaaaaattttaaaattagctgggtgtggcgttacatgcctgtagtcccagctactcttcagagggtgaggagggaggattatttgagcctgggagttggaggttaccgtgggctgtgatcatactactgcactccagcctgggtgacagagcaagaccctgtcaaaattaagaaagaaaaaaaaaaacatgtttcctccaccctggagtaggctttcattattctctgccacaccactagttctttcctttgatcttgttgcaatgtgcaattgtatgttcatctgtctgcctgcttgtttctgcctctctcgctggactgtaagctgagtgagggcctcctcactcccctccattgtaatcaagcacccaacacagtgtctggaacattagagagacccagtgaatgtttgttgatctaatgatagaaaataaaaaatgagtttccggttctgtcaggccacttgtgcagaatagccctggacattctgaatgaagtgcaaagttggcaaggaggctgtaaatggcttattctggtccttacaaccttaatgtctccctttatctccatgccatgcagcctgggcctggccttcttccctgattcctctacaggagctcttggtcacagatgcagtgacttaagtggactatgtgtatggggattaatgaactcgatcaccatttaataccaggtgtttaaaatgaaaagtatctgggcgcggtggctcacacctgtgatcccagcactttgggaggccgaggcgggcggatcacgaggtcaggagatcgagaccatcctggctaacacggtgaaaccccgtctctactaaaaatacaaaaaaaattagccgggtgtggtggcgggcgcctgtagtcccagctactgtgggaggctgaggcagaagaatggcgtgaacccgggaggcggagcttgcagtaagccgagatcgcggcactgcacttcagcctgggcgacagagcaagattccgtctcaaaaaaaaaaaaaaaaaaggaaaggaaagaaaagtatccccttattgggcatgtggagggaaaagctagaaagggcaccagtcagccagctaagccacctttttttctagcatgccccgattgtgagggcactgtcctgcagagcagtcagtcctgtcttccctaactgagggagggtgggagtctcagacccgactgacacaatgacgtaacgccaagcagagcagcccccggccaggttgcaggcacacgccatttctggtgtcctttgaaagtggcacagcttcaggccgggcaccgtggctcacgcctgtaatcccagcactttgggaggctgaggtggatggaccacctgaggtcaggagttcgagaccagactggccaacatagcaaaaccccatctctactaaaaatacaaaaattagccaggcatgatggcacacacctgtaatcccagctattcgggaggctgagacgggagaatcgcttgagctcaggatgcggaggttgcagtgacccgagattgcacgactgcaatccagcctgggtgacagagtaagaatctgtctaaaaaaaaaatacataaacaaaagaaaagaaagaaagtggcaccgctcctccctggctctcccagcaaaggctgttaaatcaggagaggatggtggttccaggagcttctccttcatgagctgcttcccttaagacccaggcagttcagagttttatggctggggccaggtgtggtggctcaggcctataatcccagcactttgggaggctgaggtgggaggatcatttgaagccaggagttcaagaccagcctgggcaacatagcaaggctcccatctctacagaaaaaaaattttaaatgttatctaggcatggtggcacaagcctgtagtcccagctattcaggaggctgaggtaggaggatcacttgaaccaaggaatgaaaggtagcagtgatttatgatcatgccgctgcactccagtctgggcaacagagtgagacctcgtgtctaaaaaaaaaggcttatgatcaataaatccgaacctgcctgggtcctgatcaccaatgcaaagttgtcttttcattcacagcattaggctaaaccatactcagtatccaaacagtggcctttgactatattgttttttccaaaaataggactatgtgtagaagagagcccccgtacataccttatcaaccatttcatccaccatttgtaaaaatctcatcttctgggtctggatactcaaaaacagatcttgattaacagccccttccccacattgccctgggcagaaaatgcaagtcaactctccccctctcagctccaggagctccggcatgagaacgtggccctctacctggggcttttcctggctcggggagcagaaggccctgcggccctctgggagggcaacctggctgtggtctcagagcactgcacgcggggctctcttcaggacctcctcgctcagagagaaataaagctggactggatgttcaagtcctccctcctgctggaccttatcaaggtgtgtgtctgggggtggtggggtgacgtcctgggggcagggatggggagcaagggaaccaagcaggctgaggctgcctcttaccctacccattccaagggaataaggtatctgcaccatcgaggcgtggctcatgggcggctgaagtcacggaactgcatagtggatggcagattcgtactcaagatcactgaccacggccacgggagactgctggaagcacagaaggtgctaccggagcctcccagagcggagggtaagagtcccctgtgcagacgaggatccaccgggatccccattatttcaagggcttctcccccgcttcctccctacctctgccctcgcactctcttcatcccacatccaccagacacaattcctgctacagaaaagatcttgtggcctctgagagggtgggctctgtgacttcggagacggggctgctgggggcgggacttgtacctgagctgcctgcagcagggtttgctctgattacaagtttgcctgagggtggggcttgtgcccaagagacggagccttccctgggcaccaccttttctgaagggcaaggcctatttgccaggctttctctgagatggctcctagagatagttgcagggctggtctcaggttgcagggtctcagaccggtctcaggctgcagggttggtggtgtctgggtgccaacctgggctttctggtgagggtgggagtctttccccagcggcgcctcagccccttccccatccccagaccagctgtggacagccccggagctgcttagggacccagccctggagcgccggggaacgctggccggcgacgtctttagcttggccatcatcatgcaagaagtagtgtgccgcagtgccccttatgccatgctggagctcactcccgagggtaaggctgccctgtgcgtggagttcggcccacaggggcaccctgcagttagaaaagagccagcctcactctttcctctaaagcaaagcccagtgatgaaactcaattatacggaggcccccttaaagctggcatctgcaggtctgggtgcagaaagccgtgcatggccagggtggggagcgtggttcattaggtcccagaccacaacagcttcctctttcttgatgctggaaccaaactgtttccacaactgacagaacagactcctctctgttctcaggggtccctgggaggagcaggggagggggagtgggtgcatcccttctgcacaggactctgagcaaactacttgatcacctatccctcacttgtcttacatacaatatgttagtttctttgcctatgtcacctcttactgacccccagagttcgaggtcctcttgttcctcctagcaacccccttccacactatactctccctccacacacacacactgaacctctgatgtaaagaaacccctgccaggcaccccctcccacatcttggtcttcaacagtcaggccagggtcagaggcagcctttgtgttctgggggcactccccctcactgtcccctcatgcctccagaagtggtgcagagggtgcggagcccccctccactgtgtcggcccttggtgtccatggaccaggcacctgtcgagtgtatcctcctgatgaagcagtgctgggcagagcagccggaacttcggccctccatggaccacaccttcgacctggtcaggggctgggagtgggcaaggactgggctggcctctgggatcccagatgcttgtcagcaacctgagacagctgcagacaggcaggctggcaggacctctggccttccaggctacctcctaaggagtagcctgaagactcggagtttgggggcagaattggaatgggggctgtggaggcttttggagtgggagatagagttctgtctgggtgggaggaatattcaattcaattcaaataacactgattgagaaccaagtatgtgcttggcctgctgtgacagaaagacccttggcctgggagcccaacgattgggctggctccagtgccctgtcaattactagctgagatcaactgacctctgggaaccctcatttcccacgtgcctcctaatcgtgtctgaaaacacagtgcccagcaccccggggtgcttgatgaatagtagatgaatggtggcagcggggttggggttcagagtgaacagccccatgagagggcccatgaggggggcataaagagggcatggcaacccaggtcttcagcagctttaccagcttccttctactgctagttcaagaacatcaacaagggccggaagacgaacatcattgactcgatgcttcggatgctggagcagtactctagtaacctggaggatctgatccgggagcgcacggaggagctggagctggaaaagcagaagacagaccggctgcttacacagatgctgcctccgtgggtgccagtgggaaggggtgggctgggagggcagctggagcccagccaggtagagtggcccccaggtgacctcactgcctgccatccctaggtctgtggctgaggccttgaagacggggacaccagtggagcccgagtactttgagcaagtgacactgtactttagtgacattgtgggcttcaccaccatctctgccatgagtgagcccattgaggttgtggacctgctcaacgatctctacacactctttgatgccatcattggttcccacgatgtctacaaggtgcagtgtgtaggggacaagccctcctgaccttcaattcagcttcaccagcctccagcccagcccttcctgcgcagcccctagcctacctgcccaatcaatcttctttcccagacctcctgtcccttatttattcctccagtccccagctcagtccttccactagcaacctggttctgcactaaccccaggtgggcccggtgacaagaggcaatcgcttcgtgtactcggggggaatgctcaaaagaaaattcacacaactccttcttcccccaggtggagacaataggggacgcctatatggtggcctcggggctgccccagcggaatgggcagcgacacgcggcagagatcgccaacatgtcactggacatcctcagtgccgtgggcactttccgcatgcgccatatgcctgaggttcccgtgcgcatccgcataggcctgcactcgggtaactcccgggtcttcccaggctccagcccatctccctctttagggcctggccccagatttcctgtagaggaggcaactcatggagcggggagtggggcttaccttgaagaggatgcacttaacaaggcttatttggggggctggtggagataatgggtgcgaagatcccccgaggccctacctaggtgcagcccagggccggccctgctagccccgccgacccccagcatctccacaggtccatgcgtggcaggcgtggtgggcctcaccatgccgcggtactgcctgtttggggacacggtcaacaccgcctcgcgcatggagtccaccgggctgcgtgagtgtgacggggacaagacggggaggtgggagggggacacgggaggtgagtcccgagctcacggcgtcccccaccgccacagcttaccgcatccacgtgaacttgagcactgtggggattctccgtgctctggactcgggctaccaggtggagctgcgaggccgcacggagctgaaggtgaggcagggccccaacccctcccggaggccccgccctgtcctgaggcaccgcccatcccgggccgcggctgcaaacctcagctcacccttctgacctggtctcccagttccacgcagactcgagatcccccacccctcaccccagtccgcctaagtccttccctctcccatgtctccccagggcaagggcgccgaggacactttctggctagtgggcagacgcggcttcaacaagcccatccccaaaccgcctgacctgcaaccggggtgaggggccggcctccgcggcagggcgagggacgagggacccctgcctcctgctctgtgtctgaccccccgcgcgcgaggcagcgatgacgtgggccctgccctcccacgccccattccccttccctgaggccaccgccccctccttgcaggtccagcaaccacggcatcagcctgcaggagatcccacccgagcggcgacggaagctggagaaggcgcggccgggccagttctcttgagaagtgaggcccggccccggacaggtactgccccctcagccccaaccccagctgccgcgtcccctctgctgcctgcagaacgtcccacccaagccaggtgtcccgatccctttctgacttagagagcccaggctggttcctaaaccccggggcttcccctgggagggaagcagccattgcaggaattttggttcagtagatctggagtggtttggaaatccaggcttaggaaactccgtaatcggggccttctgtggcccctcccctggccctatctcatccccagtgcataaacctggcttccgcagaagcctcacaggctgtgcactgcacaagagacaactctagggggcagcagtcaccagagaacaatgtgaaagcagaagccgtgcccactcccctcctgcaagaaactgacccgtgacccgctccttcctaggtgaacccccatgacccctttcctcgactcccctctgagatacccctcttttcttcaggattgttctggaaggtccttttcctgaaagttgctgctataggtgactggaagtctgtctaatgctggtggactctgcccagctctgcctcaaaggattttgggccttttacaagagctggttgcaaaaccagccatgtgaccttgggaaagtgtcacgcatgctctgctgtgatcccttcagtggcaaaatggggggtggcctaagtggttcccaaggcccctgtgcacctgacagctgggtggcttgtggccctcacccccaggagccctgagtccagcaggggatgtgagggtcagggattctccgcttcccagtgtctctcagggacccaggaaggaggatctgggattgatgcccgaccccagaggaagtggagttctgttccaccagagcagggtttgtcacatggcctgagggggcaagggctcctgtttagcctcaagcttcattcctatctccatctcccaccagtcagaaactggctgcttctcctgtgggtataatcagggaacttgcccaagtgcagagaaaagcttgcttcaatgctttgaggaaaggaaattgtgccacaccttgactgaccagaacatccaaagagcggcattctctgtttaactaggagctgctgagcaagcagttggacagaaaatcctctctgcttagaattttttctttttttttgagtctcactttgtcacccaggctggagtgcagtgcagtgacacaatctcgactcattgcaacctcctcctctcaggttcaagtgattctcctacctcagcctgccgagtagctgggattacaggcacccgccaccacgcccgggtaatttttttgtgtgattttagtagagatggggtttcagcatgttgcccagggtggtcttgaactgacatcaagtgatctgcccaccttggcctcccaaagtgctgggattacaggtgtgagacaccgcgcctgacctttgcagcaattatcaatgccctgtcctggcaagtccccagttgaagttgcctttgtgaaactctgaccttccagagcctgggccttggcacatttgactcttggtgtctgtcaccattgctacagaccctggaagaagtttgcagcaggctaggaaaccacctaggctgccaccagaggtagtgagtgtccagtccctggaggtgtgaaggcagaactggagacatcattgaccagggatacgacagtgagagggaattccggaactgaaccttcactacaccaagtgtggttggtgggccagggtcggcactgcctgtgagctcattagaaatgaaggatctcagggccccaccccagacctgctgagtctggatctgcattttaacaagttcctacaaaatattgacacgctcattaaagtttctgaatcatagaactaaatcaccctaagatctttaaatcttagaatctctaagatctcataaagccaggctacaaactagccaccaaatttcttttgtttggcctatagagtgttttgttttgagctaacatttaaaaatcaacagcttccacattttaaaaatgtatagcagatttcccccttctcttgaaatcagaagccccacatggtgcttgtgtcaccacttaaccacattctgctgcagctaaacagcaacagtcccctttatccagatgtcgccactccccacagactccgagacaccaagattttttgaacattcctttatattcctgcctggtgcctgtagacattgagcttaggactccttagcaggtattaggattacaggggctcctggacgggactttgccttcttttttttttttttaaactgattcatgacttccacaagcttagtggtattcccctccttcctaaaggtgaaggaagaatgtatcaaacatcgagaatccagcacttgtaagttctggttaccgaaggtgatgttgctacagagagcaatttagtgcaattttaaaaacattttaaattgaatttaaatacgatgaattaaagattaaaaacaaaacaaaacccgggcatgcacacacacacatttttaaaagttatttacattcttgaagattttccttaagattttctctgtacttaggtcccagggattgaagcgcagattcacatctctggccttggacctgactgtgtggatagagctctcagcctcctgtctcttccctcccgtacccgaccctgcagcccttccccttccttccctctctccctgcctgcaagggcctggagtagttaatggtgtgtgatttcggctgcctcaaggaagagtccaggattaggtgcagagggattagctgggacaggcttaggcagggctcctcccggaagcagaggcggatgagccagagggcagacccagtttaaggtagaagtggagtgggcagggctgagccagttccttcccaccttcactcagcctccttcccaggctggcctcaagctcaagtgaccagatgtgatagaagagccctgacccctccccagctagaagaacttggggaacccccaccccagagttcacagatctagtgggagaagagaaggcaaaagatgaagcctcagcctcctctctgtgcctcagcctctcctttctctgttcctgcctccctttctgctctattctcctgtctttgtgtccccacagtcccctttctgcctggcagtctctgtctgcctttctctgcagtttccaccatttctctggaaatcttatttcctggacccagtcggttatccagtctcagggctctgctgactcaagtcctccccaccctgttcctgtggcctgggcaactcccagcgcatgagagcaccggggcctggcttggtcactgggcatcccccaccttcagatgtgtttacactacctctgccagctggcctgcgccaggagcccacacttgcggttgtccttgccttggagatggctctgtagctggcagagcagtgatggccaaagcagggacctctcatagctgctgcttcaatcccacggcagagactctacagcgtgtcccggggctcacctggcgccttttttttttttttttttttttttgtgcttctccttagggtctgggccctgctccctgtcccatctgcagtggaccccaggcacccccctttgaggaggtggggtgaactgctccttggcagggatttgtgacactgcattgctgggctgtgttcctcgggctcttctggaccttgcaccgtggataccaggccatgtgccatggtatttgggtcctgggagggtgggtgaaataaaggcatgctgtctt

SEQ ID NO: 5267 - RNA, 110 nt, Artificial Sequence
  chemically synthesized
  misc_base (1)..(30): n is a, c, g, u, or other and this region may encompass 17-30 nucleotides
  misc_feature (1)..(30): n is a, c, g, or u
nnnnnnnnnnnnnnnnnnnnnnnnnnnnnnguuuuagagcuagaaauagcaaguuaaaauaaggcuaguccguuaucaacuugaaaaaguggcaccgagucggugcuuuu

SEQ ID NO: 5268 - RNA, 106 nt, Artificial Sequence
  chemically synthesized
  misc_base (1)..(30): n is a, c, g, u, or other and this region may encompass 17-30 nucleotides
  misc_feature (1)..(30): n is a, c, g, or u
nnnnnnnnnnnnnnnnnnnnnnnnnnnnnnguuuuagagcuagaaauagcaaguuaaaauaaggcuaguccguuaucaacuugaaaaaguggcaccgagucggugc

SEQ ID NO: 5269 - RNA, 114 nt, Artificial Sequence
  chemically synthesized
  misc_base (1)..(30): n is a, c, g, u, or other and this region may encompass 17-30 nucleotides;
  misc_feature (1)..(30): n is a, c, g, or u
  modified_base (107)..(114): This region may encompass 1-8 uracil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 5270 - DNA, 23 bp, Artificial Sequence
  Description of Artificial Sequence:  Synthetic Oligonucleotide
  misc_feature (1)..(21): n is a, c, g, t, unknown, or other
nnnnnnnnnnnnnnnnnnnnnrg

SEQ ID NO: 5271 - protein, 9 aa, Unknown
  Description of Unknown: Homing endonuclease sequence
LAGLIDADG

SEQ ID NO: 5272 - RNA, 20 nt, Artificial Sequence
  Chemically Synthesized
uccagcuccuccgugcgcuc

SEQ ID NO: 5273 - RNA, 19 nt, Artificial Sequence
  Chemically Synthesized
ccagcuccuccgugcgcuc

SEQ ID NO: 5274 - RNA, 20 nt, Artificial Sequence
  Chemically Synthesized
ucugauccgggagcgcacgg

SEQ ID NO: 5275 - RNA, 20 nt, Artificial Sequence
  Chemically Synthesized
ggaucugauccgggagcgca

SEQ ID NO: 5276 - RNA, 20 nt, Artificial Sequence
  Chemically Synthesized
ccagcuccuccgugcgcucc

SEQ ID NO: 5277 - RNA, 20 nt, Artificial Sequence
  Chemically Synthesized
ccgggagcgcacggaggagc

SEQ ID NO: 5278 - RNA, 19 nt, Artificial Sequence
  Chemically Synthesized
cugauccgggagcgcacgg

SEQ ID NO: 5279 - RNA, 19 nt, Artificial Sequence
  Chemically Synthesized
gaucugauccgggagcgca

SEQ ID NO: 5280 - RNA, 19 nt, Artificial Sequence
  Chemically Synthesized
cagcuccuccgugcgcucc

SEQ ID NO: 5281 - RNA, 19 nt, Artificial Sequence
  Chemically Synthesized
cgggagcgcacggaggagc

SEQ ID NO: 5282 - RNA, 20 nt, Artificial Sequence
  Chemically Synthesized
uccagcuccuccgugugcuc

SEQ ID NO: 5283 - RNA, 19 nt, Artificial Sequence
  Chemically Synthesized
ccagcuccuccgugugcuc

SEQ ID NO: 5284 - RNA, 20 nt, Artificial Sequence
  Chemically Synthesized
ucugauccgggagcacacgg

SEQ ID NO: 5285 - RNA, 20 nt, Artificial Sequence
  Chemically Synthesized
ggaucugauccgggagcaca

SEQ ID NO: 5286 - RNA, 20 nt, Artificial Sequence
  Chemically Synthesized
ccagcuccuccgugugcucc

SEQ ID NO: 5287 - RNA, 20 nt, Artificial Sequence
  Chemically Synthesized
ccgggagcacacggaggagc

SEQ ID NO: 5288 - RNA, 20 nt, Artificial Sequence
  Chemically Synthesized
gcacacggaggagcuggagc

SEQ ID NO: 5289 - RNA, 19 nt, Artificial Sequence
  Chemically Synthesized
cugauccgggagcacacgg

SEQ ID NO: 5290 - RNA, 19 nt, Artificial Sequence
  Chemically Synthesized
gaucugauccgggagcaca

SEQ ID NO: 5291 - RNA, 19 nt, Artificial Sequence
  Chemically Synthesized
cagcuccuccgugugcucc

SEQ ID NO: 5292 - RNA, 19 nt, Artificial Sequence
  Chemically Synthesized
cgggagcacacggaggagc

SEQ ID NO: 5293 - RNA, 19 nt, Artificial Sequence
  Chemically Synthesized
cacacggaggagcuggagc

SEQ ID NO: 5294 - RNA, 20 nt, Artificial Sequence
  Chemically Synthesized
uccagcuccuccgugcacuc

SEQ ID NO: 5295 - RNA, 19 nt, Artificial Sequence
  Chemically Synthesized
ccagcuccuccgugcacuc

SEQ ID NO: 5296 - RNA, 20 nt, Artificial Sequence
  Chemically Synthesized
ucugauccgggagugcacgg

SEQ ID NO: 5297 - RNA, 20 nt, Artificial Sequence
  Chemically Synthesized
ggaucugauccgggagugca

SEQ ID NO: 5298 - RNA, 20 nt, Artificial Sequence
  Chemically Synthesized
ccagcuccuccgugcacucc

SEQ ID NO: 5299 - RNA, 20 nt, Artificial Sequence
  Chemically Synthesized
ccgggagugcacggaggagc

SEQ ID NO: 5300 - RNA, 19 nt, Artificial Sequence
  Chemically Synthesized
gaucugauccgggagugca

SEQ ID NO: 5301 - RNA, 19 nt, Artificial Sequence
  Chemically Synthesized
cugauccgggagugcacgg

SEQ ID NO: 5302 - RNA, 19 nt, Artificial Sequence
  Chemically Synthesized
cagcuccuccgugcacucc

SEQ ID NO: 5303 - RNA, 19 nt, Artificial Sequence
  Chemically Synthesized
cgggagugcacggaggagc

SEQ ID NO: 5304 - RNA, 20 nt, Artificial Sequence
  Chemically Synthesized
ucugauccgggagagcacgg

SEQ ID NO: 5305 - RNA, 20 nt, Artificial Sequence
  Chemically Synthesized
ggaucugauccgggagagca

SEQ ID NO: 5306 - RNA, 20 nt, Artificial Sequence
  Chemically Synthesized
ccagcuccuccgugcucucc

SEQ ID NO: 5307 - RNA, 20 nt, Artificial Sequence
  Chemically Synthesized
ccgggagagcacggaggagc

SEQ ID NO: 5308 - RNA, 19 nt, Artificial Sequence
  Chemically Synthesized
gaucugauccgggagagca

SEQ ID NO: 5309 - RNA, 19 nt, Artificial Sequence
  Chemically Synthesized
cugauccgggagagcacgg

SEQ ID NO: 5310 - RNA, 19 nt, Artificial Sequence
  Chemically Synthesized
cagcuccuccgugcucucc

SEQ ID NO: 5311 - RNA, 19 nt, Artificial Sequence
  Chemically Synthesized
cgggagagcacggaggagc

SEQ ID NO: 5312 - RNA, 20 nt, Artificial Sequence
  Chemically Synthesized
uccagcuccuccgugcucuc

SEQ ID NO: 5313 - RNA, 19 nt, Artificial Sequence
  Chemically Synthesized
ccagcuccuccgugcucuc

SEQ ID NO: 5314 - DNA, 20 bp, Artificial Sequence
  Chemically Synthesized
tccagctcctccgtgcgctc

SEQ ID NO: 5315 - DNA, 19 bp, Artificial Sequence
  Chemically Synthesized
ccagctcctccgtgcgctc

SEQ ID NO: 5316 - DNA, 20 bp, Artificial Sequence
  Chemically Synthesized
tctgatccgggagcgcacgg

SEQ ID NO: 5317 - DNA, 20 bp, Artificial Sequence
  Chemically Synthesized
ggatctgatccgggagcgca

SEQ ID NO: 5318 - DNA, 20 bp, Artificial Sequence
  Chemically Synthesized
ccagctcctccgtgcgctcc

SEQ ID NO: 5319 - DNA, 20 bp, Artificial Sequence
  Chemically Synthesized
ccgggagcgcacggaggagc

SEQ ID NO: 5320 - DNA, 19 bp, Artificial Sequence
  Chemically Synthesized
ctgatccgggagcgcacgg

SEQ ID NO: 5321 - DNA, 19 bp, Artificial Sequence
  Chemically Synthesized
gatctgatccgggagcgca

SEQ ID NO: 5322 - DNA, 19 bp, Artificial Sequence
  Chemically Synthesized
cagctcctccgtgcgctcc

SEQ ID NO: 5323 - DNA, 19 bp, Artificial Sequence
  Chemically Synthesized
cgggagcgcacggaggagc

SEQ ID NO: 5324 - DNA, 20 bp, Artificial Sequence
  Chemically Synthesized
tccagctcctccgtgtgctc

SEQ ID NO: 5325 - DNA, 19 bp, Artificial Sequence
  Chemically Synthesized
ccagctcctccgtgtgctc

SEQ ID NO: 5326 - DNA, 20 bp, Artificial Sequence
  Chemically Synthesized
tctgatccgggagcacacgg

SEQ ID NO: 5327 - DNA, 20 bp, Artificial Sequence
  Chemically Synthesized
ggatctgatccgggagcaca

SEQ ID NO: 5328 - DNA, 20 bp, Artificial Sequence
  Chemically Synthesized
ccagctcctccgtgtgctcc

SEQ ID NO: 5329 - DNA, 20 bp, Artificial Sequence
  Chemically Synthesized
ccgggagcacacggaggagc

SEQ ID NO: 5330 - DNA, 20 bp, Artificial Sequence
  Chemically Synthesized
gcacacggaggagctggagc

SEQ ID NO: 5331 - DNA, 19 bp, Artificial Sequence
  Chemically Synthesized
ctgatccgggagcacacgg

SEQ ID NO: 5332 - DNA, 19 bp, Artificial Sequence
  Chemically Synthesized
gatctgatccgggagcaca

SEQ ID NO: 5333 - DNA, 19 bp, Artificial Sequence
  Chemically Synthesized
cagctcctccgtgtgctcc

SEQ ID NO: 5334 - DNA, 19 bp, Artificial Sequence
  Chemically Synthesized
cgggagcacacggaggagc

SEQ ID NO: 5335 - DNA, 19 bp, Artificial Sequence
  Chemically Synthesized
cacacggaggagctggagc

SEQ ID NO: 5336 - DNA, 20 bp, Artificial Sequence
  Chemically Synthesized
tccagctcctccgtgcactc

SEQ ID NO: 5337 - DNA, 19 bp, Artificial Sequence
  Chemically Synthesized
ccagctcctccgtgcactc

SEQ ID NO: 5338 - DNA, 20 bp, Artificial Sequence
  Chemically Synthesized
tctgatccgggagtgcacgg

SEQ ID NO: 5339 - DNA, 20 bp, Artificial Sequence
  Chemically Synthesized
ggatctgatccgggagtgca

SEQ ID NO: 5340 - DNA, 20 bp, Artificial Sequence
  Chemically Synthesized
ccagctcctccgtgcactcc

SEQ ID NO: 5341 - DNA, 20 bp, Artificial Sequence
  Chemically Synthesized
ccgggagtgcacggaggagc

SEQ ID NO: 5342 - DNA, 19 bp, Artificial Sequence
  Chemically Synthesized
gatctgatccgggagtgca

SEQ ID NO: 5343 - DNA, 19 bp, Artificial Sequence
  Chemically Synthesized
ctgatccgggagtgcacgg

SEQ ID NO: 5344 - DNA, 19 bp, Artificial Sequence
  Chemically Synthesized
cagctcctccgtgcactcc

SEQ ID NO: 5345 - DNA, 19 bp, Artificial Sequence
  Chemically Synthesized
cgggagtgcacggaggagc

SEQ ID NO: 5346 - DNA, 20 bp, Artificial Sequence
  Chemically Synthesized
tctgatccgggagagcacgg

SEQ ID NO: 5347 - DNA, 20 bp, Artificial Sequence
  Chemically Synthesized
ggatctgatccgggagagca

SEQ ID NO: 5348 - DNA, 20 bp, Artificial Sequence
  Chemically Synthesized
ccagctcctccgtgctctcc

SEQ ID NO: 5349 - DNA, 20 bp, Artificial Sequence
  Chemically Synthesized
ccgggagagcacggaggagc

SEQ ID NO: 5350 - DNA, 19 bp, Artificial Sequence
  Chemically Synthesized
gatctgatccgggagagca

SEQ ID NO: 5351 - DNA, 19 bp, Artificial Sequence
  Chemically Synthesized
ctgatccgggagagcacgg

SEQ ID NO: 5352 - DNA, 19 bp, Artificial Sequence
  Chemically Synthesized
cagctcctccgtgctctcc

SEQ ID NO: 5353 - DNA, 19 bp, Artificial Sequence
  Chemically Synthesized
cgggagagcacggaggagc

SEQ ID NO: 5354 - DNA, 20 bp, Artificial Sequence
  Chemically Synthesized
tccagctcctccgtgctctc

SEQ ID NO: 5355 - DNA, 19 bp, Artificial Sequence
  Chemically Synthesized
ccagctcctccgtgctctc

SEQ ID NO: 5356 - DNA, 20 bp, Artificial Sequence
  Chemically Synthesized
ctcgcgtgcctcctcgacct

SEQ ID NO: 5357 - DNA, 19 bp, Artificial Sequence
  Chemically Synthesized
ctcgcgtgcctcctcgacc

SEQ ID NO: 5358 - DNA, 20 bp, Artificial Sequence
  Chemically Synthesized
ggcacgcgagggcctagtct

SEQ ID NO: 5359 - DNA, 20 bp, Artificial Sequence
  Chemically Synthesized
acgcgagggcctagtctagg

SEQ ID NO: 5360 - DNA, 20 bp, Artificial Sequence
  Chemically Synthesized
cctcgcgtgcctcctcgacc

SEQ ID NO: 5361 - DNA, 20 bp, Artificial Sequence
  Chemically Synthesized
cgaggaggcacgcgagggcc

SEQ ID NO: 5362 - DNA, 19 bp, Artificial Sequence
  Chemically Synthesized
ggcacgcgagggcctagtc

SEQ ID NO: 5363 - DNA, 19 bp, Artificial Sequence
  Chemically Synthesized
acgcgagggcctagtctag

SEQ ID NO: 5364 - DNA, 19 bp, Artificial Sequence
  Chemically Synthesized
cctcgcgtgcctcctcgac

SEQ ID NO: 5365 - DNA, 19 bp, Artificial Sequence
  Chemically Synthesized
cgaggaggcacgcgagggc

SEQ ID NO: 5366 - DNA, 20 bp, Artificial Sequence
  Chemically Synthesized
ctcgtgtgcctcctcgacct

SEQ ID NO: 5367 - DNA, 19 bp, Artificial Sequence
  Chemically Synthesized
ctcgtgtgcctcctcgacc

SEQ ID NO: 5368 - DNA, 20 bp, Artificial Sequence
  Chemically Synthesized
ggcacacgagggcctagtct

SEQ ID NO: 5369 - DNA, 20 bp, Artificial Sequence
  Chemically Synthesized
acacgagggcctagtctagg

SEQ ID NO: 5370 - DNA, 20 bp, Artificial Sequence
  Chemically Synthesized
cctcgtgtgcctcctcgacc

SEQ ID NO: 5371 - DNA, 20 bp, Artificial Sequence
  Chemically Synthesized
cgaggaggcacacgagggcc

SEQ ID NO: 5372 - DNA, 20 bp, Artificial Sequence
  Chemically Synthesized
cgaggtcgaggaggcacacg

SEQ ID NO: 5373 - DNA, 19 bp, Artificial Sequence
  Chemically Synthesized
ggcacacgagggcctagtc

SEQ ID NO: 5374 - DNA, 19 bp, Artificial Sequence
  Chemically Synthesized
acacgagggcctagtctag

SEQ ID NO: 5375 - DNA, 19 bp, Artificial Sequence
  Chemically Synthesized
cctcgtgtgcctcctcgac

SEQ ID NO: 5376 - DNA, 19 bp, Artificial Sequence
  Chemically Synthesized
cgaggaggcacacgagggc

SEQ ID NO: 5377 - DNA, 19 bp, Artificial Sequence
  Chemically Synthesized
cgaggtcgaggaggcacac

SEQ ID NO: 5378 - DNA, 20 bp, Artificial Sequence
  Chemically Synthesized
ctcacgtgcctcctcgacct

SEQ ID NO: 5379 - DNA, 19 bp, Artificial Sequence
  Chemically Synthesized
ctcacgtgcctcctcgacc

SEQ ID NO: 5380 - DNA, 20 bp, Artificial Sequence
  Chemically Synthesized
ggcacgtgagggcctagtct

SEQ ID NO: 5381 - DNA, 20 bp, Artificial Sequence
  Chemically Synthesized
acgtgagggcctagtctagg

SEQ ID NO: 5382 - DNA, 20 bp, Artificial Sequence
  Chemically Synthesized
cctcacgtgcctcctcgacc

SEQ ID NO: 5383 - DNA, 20 bp, Artificial Sequence
  Chemically Synthesized
cgaggaggcacgtgagggcc

SEQ ID NO: 5384 - DNA, 19 bp, Artificial Sequence
  Chemically Synthesized
acgtgagggcctagtctag

SEQ ID NO: 5385 - DNA, 19 bp, Artificial Sequence
  Chemically Synthesized
ggcacgtgagggcctagtc

SEQ ID NO: 5386 - DNA, 19 bp, Artificial Sequence
  Chemically Synthesized
cctcacgtgcctcctcgac

SEQ ID NO: 5387 - DNA, 19 bp, Artificial Sequence
  Chemically Synthesized
cgaggaggcacgtgagggc

SEQ ID NO: 5388 - DNA, 20 bp, Artificial Sequence
  Chemically Synthesized
ccgtgctctcccggatcaga

SEQ ID NO: 5389 - DNA, 20 bp, Artificial Sequence
  Chemically Synthesized
tgctctcccggatcagatcc

SEQ ID NO: 5390 - DNA, 20 bp, Artificial Sequence
  Chemically Synthesized
ggagagcacggaggagctgg

SEQ ID NO: 5391 - DNA, 20 bp, Artificial Sequence
  Chemically Synthesized
gctcctccgtgctctcccgg

SEQ ID NO: 5392 - DNA, 19 bp, Artificial Sequence
  Chemically Synthesized
tgctctcccggatcagatc

SEQ ID NO: 5393 - DNA, 19 bp, Artificial Sequence
  Chemically Synthesized
ccgtgctctcccggatcag

SEQ ID NO: 5394 - DNA, 19 bp, Artificial Sequence
  Chemically Synthesized
ggagagcacggaggagctg

SEQ ID NO: 5395 - DNA, 19 bp, Artificial Sequence
  Chemically Synthesized
gctcctccgtgctctcccg

SEQ ID NO: 5396 - DNA, 20 bp, Artificial Sequence
  Chemically Synthesized
gagagcacggaggagctgga

SEQ ID NO: 5397 - DNA, 19 bp, Artificial Sequence
  Chemically Synthesized
gagagcacggaggagctgg

SEQ ID NO: 5398 - RNA, 20 nt, Artificial Sequence
  Chemically Synthesized
ucugauccgggaguacacgg

SEQ ID NO: 5399 - RNA, 20 nt, Artificial Sequence
  Chemically Synthesized
ggaucugauccgggaguaca

SEQ ID NO: 5400 - RNA, 20 nt, Artificial Sequence
  Chemically Synthesized
ccagcuccuccguguacucc

SEQ ID NO: 5401 - RNA, 20 nt, Artificial Sequence
  Chemically Synthesized
guacacggaggagcuggagc

SEQ ID NO: 5402 - RNA, 20 nt, Artificial Sequence
  Chemically Synthesized
ccgggaguacacggaggagc

SEQ ID NO: 5403 - RNA, 19 nt, Artificial Sequence
  Chemically Synthesized
cugauccgggaguacacgg

SEQ ID NO: 5404 - RNA, 19 nt, Artificial Sequence
  Chemically Synthesized
gaucugauccgggaguaca

SEQ ID NO: 5405 - RNA, 19 nt, Artificial Sequence
  Chemically Synthesized
cagcuccuccguguacucc

SEQ ID NO: 5406 - RNA, 19 nt, Artificial Sequence
  Chemically Synthesized
uacacggaggagcuggagc

SEQ ID NO: 5407 - RNA, 19 nt, Artificial Sequence
  Chemically Synthesized
cgggaguacacggaggagc

SEQ ID NO: 5408 - RNA, 20 nt, Artificial Sequence
  Chemically Synthesized
uccagcuccuccguguacuc

SEQ ID NO: 5409 - RNA, 19 nt, Artificial Sequence
  Chemically Synthesized
ccagcuccuccguguacuc

SEQ ID NO: 5410 - DNA, 20 bp, Artificial Sequence
  Chemically Synthesized
tctgatccgggagtacacgg

SEQ ID NO: 5411 - DNA, 20 bp, Artificial Sequence
  Chemically Synthesized
ggatctgatccgggagtaca

SEQ ID NO: 5412 - DNA, 20 bp, Artificial Sequence
  Chemically Synthesized
ccagctcctccgtgtactcc

SEQ ID NO: 5413 - DNA, 20 bp, Artificial Sequence
  Chemically Synthesized
gtacacggaggagctggagc

SEQ ID NO: 5414 - DNA, 20 bp, Artificial Sequence
  Chemically Synthesized
ccgggagtacacggaggagc

SEQ ID NO: 5415 - DNA, 19 bp, Artificial Sequence
  Chemically Synthesized
ctgatccgggagtacacgg

SEQ ID NO: 5416 - DNA, 19 bp, Artificial Sequence
  Chemically Synthesized
gatctgatccgggagtaca

SEQ ID NO: 5417 - DNA, 19 bp, Artificial Sequence
  Chemically Synthesized
cagctcctccgtgtactcc

SEQ ID NO: 5418 - DNA, 19 bp, Artificial Sequence
  Chemically Synthesized
tacacggaggagctggagc

SEQ ID NO: 5419 - DNA, 19 bp, Artificial Sequence
  Chemically Synthesized
cgggagtacacggaggagc

SEQ ID NO: 5420 - DNA, 20 bp, Artificial Sequence
  Chemically Synthesized
tccagctcctccgtgtactc

SEQ ID NO: 5421 - DNA, 19 bp, Artificial Sequence
  Chemically Synthesized
ccagctcctccgtgtactc

SEQ ID NO: 5422 - DNA, 20 bp, Artificial Sequence
  Chemically Synthesized
ccgtgtactcccggatcaga

SEQ ID NO: 5423 - DNA, 20 bp, Artificial Sequence
  Chemically Synthesized
tgtactcccggatcagatcc

SEQ ID NO: 5424 - DNA, 20 bp, Artificial Sequence
  Chemically Synthesized
ggagtacacggaggagctgg

SEQ ID NO: 5425 - DNA, 20 bp, Artificial Sequence
  Chemically Synthesized
gctccagctcctccgtgtac

SEQ ID NO: 5426 - DNA, 20 bp, Artificial Sequence
  Chemically Synthesized
gctcctccgtgtactcccgg

SEQ ID NO: 5427 - DNA, 19 bp, Artificial Sequence
  Chemically Synthesized
ccgtgtactcccggatcag

SEQ ID NO: 5428 - DNA, 19 bp, Artificial Sequence
  Chemically Synthesized
tgtactcccggatcagatc

SEQ ID NO: 5429 - DNA, 19 bp, Artificial Sequence
  Chemically Synthesized
ggagtacacggaggagctg

SEQ ID NO: 5430 - DNA, 19 bp, Artificial Sequence
  Chemically Synthesized
gctccagctcctccgtgta

SEQ ID NO: 5431 - DNA, 19 bp, Artificial Sequence
  Chemically Synthesized
gctcctccgtgtactcccg

SEQ ID NO: 5432 - DNA, 20 bp, Artificial Sequence
  Chemically Synthesized
gagtacacggaggagctgga

SEQ ID NO: 5433 - DNA, 19 bp, Artificial Sequence
  Chemically Synthesized
gagtacacggaggagctgg

SEQ ID NO: 5434 - RNA, 20 nt, Artificial Sequence
  Chemically Synthesized
uccagcuccuccguguucuc

SEQ ID NO: 5435 - RNA, 19 nt, Artificial Sequence
  Chemically Synthesized
ccagcuccuccguguucuc

SEQ ID NO: 5436 - RNA, 20 nt, Artificial Sequence
  Chemically Synthesized
ggaucugauccgggagaaca

SEQ ID NO: 5437 - RNA, 20 nt, Artificial Sequence
  Chemically Synthesized
ucugauccgggagaacacgg

SEQ ID NO: 5438 - RNA, 20 nt, Artificial Sequence
  Chemically Synthesized
ccagcuccuccguguucucc

SEQ ID NO: 5439 - RNA, 20 nt, Artificial Sequence
  Chemically Synthesized
ccgggagaacacggaggagc

SEQ ID NO: 5440 - RNA, 19 nt, Artificial Sequence
  Chemically Synthesized
cugauccgggagaacacgg

SEQ ID NO: 5441 - RNA, 19 nt, Artificial Sequence
  Chemically Synthesized
gaucugauccgggagaaca

SEQ ID NO: 5442 - RNA, 19 nt, Artificial Sequence
  Chemically Synthesized
cagcuccuccguguucucc

SEQ ID NO: 5443 - RNA, 19 nt, Artificial Sequence
  Chemically Synthesized
cgggagaacacggaggagc

SEQ ID NO: 5444 - DNA, 20 bp, Artificial Sequence
  Chemically Synthesized
tccagctcctccgtgttctc

SEQ ID NO: 5445 - DNA, 19 bp, Artificial Sequence
  Chemically Synthesized
ccagctcctccgtgttctc

SEQ ID NO: 5446 - DNA, 20 bp, Artificial Sequence
  Chemically Synthesized
ggatctgatccgggagaaca

SEQ ID NO: 5447 - DNA, 20 bp, Artificial Sequence
  Chemically Synthesized
tctgatccgggagaacacgg

SEQ ID NO: 5448 - DNA, 20 bp, Artificial Sequence
  Chemically Synthesized
ccagctcctccgtgttctcc

SEQ ID NO: 5449 - DNA, 20 bp, Artificial Sequence
  Chemically Synthesized
ccgggagaacacggaggagc

SEQ ID NO: 5450 - DNA, 19 bp, Artificial Sequence
  Chemically Synthesized
ctgatccgggagaacacgg

SEQ ID NO: 5451 - DNA, 19 bp, Artificial Sequence
  Chemically Synthesized
gatctgatccgggagaaca

SEQ ID NO: 5452 - DNA, 19 bp, Artificial Sequence
  Chemically Synthesized
cagctcctccgtgttctcc

SEQ ID NO: 5453 - DNA, 19 bp, Artificial Sequence
  Chemically Synthesized
cgggagaacacggaggagc

SEQ ID NO: 5454 - DNA, 20 bp, Artificial Sequence
  Chemically Synthesized
gagaacacggaggagctgga

SEQ ID NO: 5455 - DNA, 19 bp, Artificial Sequence
  Chemically Synthesized
gagaacacggaggagctgg

SEQ ID NO: 5456 - DNA, 20 bp, Artificial Sequence
  Chemically Synthesized
tgttctcccggatcagatcc

SEQ ID NO: 5457 - DNA, 20 bp, Artificial Sequence
  Chemically Synthesized
ccgtgttctcccggatcaga

SEQ ID NO: 5458 - DNA, 20 bp, Artificial Sequence
  Chemically Synthesized
ggagaacacggaggagctgg

SEQ ID NO: 5459 - DNA, 20 bp, Artificial Sequence
  Chemically Synthesized
gctcctccgtgttctcccgg

SEQ ID NO: 5460 - DNA, 19 bp, Artificial Sequence
  Chemically Synthesized
ccgtgttctcccggatcag

SEQ ID NO: 5461 - DNA, 19 bp, Artificial Sequence
  Chemically Synthesized
tgttctcccggatcagatc

SEQ ID NO: 5462 - DNA, 19 bp, Artificial Sequence
  Chemically Synthesized
ggagaacacggaggagctg

SEQ ID NO: 5463 - DNA, 19 bp, Artificial Sequence
  Chemically Synthesized
gctcctccgtgttctcccg

SEQ ID NO: 5464 - RNA, 100 nt, Artificial Sequence
  Chemically Synthesized
  modified_base (1)..(3): 2'-O-methyl phosphorothioate nucleotides
  modified_base (97)..(99): 2'-O-methyl phosphorothioate nucleotides
ggaucugauccgggagcacaguuuuagagcuagaaauagcaaguuaaaauaaggcuaguccguuaucaacuugaaaaaguggcaccgagucggugcuuuu

SEQ ID NO: 5465 - RNA, 100 nt, Artificial Sequence
  Chemically Synthesized
  modified_base (1)..(3): 2'-O-methyl phosphorothioate nucleotides
  modified_base (97)..(99): 2'-O-methyl phosphorothioate nucleotides
ccagcuccuccgugugcuccguuuuagagcuagaaauagcaaguuaaaauaaggcuaguccguuaucaacuugaaaaaguggcaccgagucggugcuuuu

SEQ ID NO: 5466 - RNA, 100 nt, Artificial Sequence
  Chemically Synthesized
  modified_base (1)..(3): 2'-O-methyl phosphorothioate nucleotides
  modified_base (97)..(99): 2'-O-methyl phosphorothioate nucleotides
ucugauccgggaguacacggguuuuagagcuagaaauagcaaguuaaaauaaggcuaguccguuaucaacuugaaaaaguggcaccgagucggugcuuuu

SEQ ID NO: 5467 - skipped

SEQ ID NO: 5468 - DNA, 5491 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtctgatccgggagcgcacgggttttagagctagaaatagcaagttaaaataaggctagtccgttatcaacttgaaaaagtggcaccgagtcggtgcttttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5469 - DNA, 5491 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggatctgatccgggagcacagttttagagctagaaatagcaagttaaaataaggctagtccgttatcaacttgaaaaagtggcaccgagtcggtgcttttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5470 - DNA, 5491 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgccagctcctccgtgtgctccgttttagagctagaaatagcaagttaaaataaggctagtccgttatcaacttgaaaaagtggcaccgagtcggtgcttttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5471 - DNA, 5491 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtctgatccgggagtacacgggttttagagctagaaatagcaagttaaaataaggctagtccgttatcaacttgaaaaagtggcaccgagtcggtgcttttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5472 - DNA, 7264 bp, Adeno-associated virus
  misc_feature (389)..(424): SIN site upstream of Cas9 ORF
  misc_feature (4585)..(4620): SIN site downstream of Cas9 ORF
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggcaccggtgccaccatggccccaaagaagaagcggaaggtcggatccggaggatctgatccgggagcacacggaggagctggaatcgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5473 - DNA, 7259 bp, Adeno-associated virus
  misc_feature (350)..(383): SIN site upstream of Cas9 ORF
  misc_feature (4580)..(4615): SIN site downstream of Cas9 ORF
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggcaccggtaggatctgatccgggagcacacggaggagctggagccaccatggccccaaagaagaagcggaaggtcggatccgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5474 - DNA, 7206 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggcaccggtgccaccatggccccaaagaagaagcggaaggtcggatccgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgctctagagctcgctgatcaaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5475 - DNA, 7280 bp, Adeno-associated virus
  misc_feature (405)..(440): SIN site upstream of Cas9 ORF
  misc_feature (4601)..(4636): SIN site downstream of Cas9 ORF
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgctagccccggtgccaccatggccccaaagaagaagcggaaggtcggatccggaggatctgatccgggagcacacggaggagctggaatcgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5476 - DNA, 7275 bp, Adeno-associated virus
  misc_feature (366)..(399): SIN site upstream of Cas9 ORF
  misc_feature (4596)..(4631): SIN site downstream of Cas9 ORF
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgctagccccggtaggatctgatccgggagcacacggaggagctggagccaccatggccccaaagaagaagcggaaggtcggatccgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5477 - DNA, 7222 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgctagccccggtgccaccatggccccaaagaagaagcggaaggtcggatccgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgctctagagctcgctgatcaaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5478 - DNA, 36 bp, Artificial Sequence
  SIN site on AAV vectors
ggaggatctgatccgggagcacacggaggagctgga

SEQ ID NO: 5479 - DNA, 34 bp, Artificial Sequence
  SIN site on AAV vectors
aggatctgatccgggagcacacggaggagctgga

SEQ ID NO: 5480 - DNA, 36 bp, Artificial Sequence
  SIN site on AAV vectors
tccagctcctccgtgtgctcccggatcagatcctcc

SEQ ID NO: 5481 - DNA, 36 bp, Artificial Sequence
  SIN site on AAV vectors
ggaggatctgatccgggagtgcacggaggagctgga

SEQ ID NO: 5482 - DNA, 34 bp, Artificial Sequence
  SIN site on AAV vectors
aggatctgatccgggagtgcacggaggagctgga

SEQ ID NO: 5483 - DNA, 36 bp, Artificial Sequence
  SIN site on AAV vectors
tccagctcctccgtgcactcccggatcagatcctcc

SEQ ID NO: 5484 - DNA, 36 bp, Artificial Sequence
  SIN site on AAV vectors
ggaggatctgatccgggagagcacggaggagctgga

SEQ ID NO: 5485 - DNA, 34 bp, Artificial Sequence
  SIN site on AAV vectors
aggatctgatccgggagagcacggaggagctgga

SEQ ID NO: 5486 - DNA, 36 bp, Artificial Sequence
  SIN site on AAV vectors
tccagctcctccgtgctctcccggatcagatcctcc

SEQ ID NO: 5487 - DNA, 36 bp, Artificial Sequence
  SIN site on AAV vectors
ggaggatctgatccgggagaacacggaggagctgga

SEQ ID NO: 5488 - DNA, 34 bp, Artificial Sequence
  SIN site on AAV vectors
aggatctgatccgggagaacacggaggagctgga

SEQ ID NO: 5489 - DNA, 36 bp, Artificial Sequence
  SIN site on AAV vectors
tccagctcctccgtgttctcccggatcagatcctcc

SEQ ID NO: 5490 - DNA, 36 bp, Artificial Sequence
  SIN site on AAV vectors
ggaggatctgatccgggagtacacggaggagctgga

SEQ ID NO: 5491 - DNA, 34 bp, Artificial Sequence
  SIN site on AAV vectors
aggatctgatccgggagtacacggaggagctgga

SEQ ID NO: 5492 - DNA, 36 bp, Artificial Sequence
  SIN site on AAV vectors
tccagctcctccgtgtactcccggatcagatcctcc

SEQ ID NO: 5493 - DNA, 6808 bp, Adeno-associated virus
cctgcaggcagctgcgcgctcgctcgctcactgaggccgcccgggcaaagcccgggcgtcgggcgacctttggtcgcccggcctctgtgagcgagcgagcgcgcagagagggagtggccaactccatcactaggggttcctgcggcctctagaggtaccgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccgggctcccaggggcttcccagtggtccccagggaaccctcgacagggccagggcgtctctctcgtccagcaagggcagggacgggccacaggcaagggccaagggcagcagtcaggcctgctctgtctgtgaacgctcccggcttcgaaccatgaccgcctgcgcccgccgagcgggtgggcttccggaccccgggctctgcggtcccgcgtggtgggctccgtccctgccccgcctcccccgggccctgccccggctcccgctcctgctgctcctgcttctgctgcagccccccgccctctccgccgtgttcacggtgggggtcctgggcccctgggcttgcgaccccatcttctctcgggctcgcccggacctggccgcccgcctggccgccgcccgcctgaaccgcgaccccggcctggcaggcggtccccgcttcgaggtagcgctgctgcccgagccttgccggacgccgggctcgctgggggccgtgtcctccgcgctggcccgcgtgtcgggcctcgtgggtccggtgaaccctgcggcctgccggccagccgagctgctcgccgaagaagccgggatcgcgctggtgccctggggctgcccctggacgcaggcggagggcaccacggcccctgccgtgacccccgccgcggatgccctctacgccctgcttcgcgcattcggctgggcgcgcgtggccctggtcaccgccccccaggacctgtgggtggaggcgggacgctcactgtccacggcactcagggcccgggggctgcctgtcgcctccgtgacttccatggagcccttggacctgtctggagcccgggaggccctgaggaaggttcgggacgggcccagggtcacagcagtgatcatggtgatgcactcggtgctgctgggtggcgaggagcagcgctacctcctggaggccgcagaggagctgggcctgaccgatggctccctggtcttcctgcccttcgacacgatccactacgccttgtccccaggcccggaggccttggccgcactcgccaacagctcccagcttcgcagggcccacgatgccgtgctcaccctcacgcgccactgtccctctgaaggcagcgtgctggacagcctgcgcagggctcaagagcgccgcgagctgccctctgacctcaatctgcagcaggtctccccactctttggcaccatctatgacgcggtcttcttgctggcaaggggcgtggcagaagcgcgggctgccgcaggtggcagatgggtgtccggagcagctgtggcccgccacatccgggatgcgcaggtccctggcttctgcggggacctaggaggagacgaggagcccccattcgtgctgctagacacggacgcggcgggagaccggctttttgccacatacatgctggatcctgcccggggctccttcctctccgccggtacccggatgcacttcccgcgtgggggatcagcacccggacctgacccctcgtgctggttcgatccaaacaacatctgcggtggaggactggagccgggcctcgtctttcttggcttcctcctggtggttgggatggggctggctggggccttcctggcccattatgtgaggcaccggctacttcacatgcaaatggtctccggccccaacaagatcatcctgaccgtggacgacatcacctttctccacccacatgggggcacctctcgaaaggtggcccaggggagtcgatcaagtctgggtgcccgcagcatgtcagacattcgcagcggccccagccaacacttggacagccccaacattggtgtctatgagggagacagggtttggctgaagaaattcccaggggatcagcacatagctatccgcccagcaaccaagacggccttctccaagctccaggagctccggcatgagaacgtggccctctacctggggcttttcctggctcggggagcagaaggccctgcggccctctgggagggcaacctggctgtggtctcagagcactgcacgcggggctctcttcaggacctcctcgctcagagagaaataaagctggactggatgttcaagtcctccctcctgctggaccttatcaagggaataaggtatctgcaccatcgaggcgtggctcatgggcggctgaagtcacggaactgcatagtggatggcagattcgtactcaagatcactgaccacggccacgggagactgctggaagcacagaaggtgctaccggagcctcccagagcggaggaccagctgtggacagccccggagctgcttagggacccagccctggagcgccggggaacgctggccggcgacgtctttagcttggccatcatcatgcaagaagtagtgtgccgcagtgccccttatgccatgctggagctcactcccgaggaagtggtgcagagggtgcggagcccccctccactgtgtcggcccttggtgtccatggaccaggcacctgtcgagtgtatcctcctgatgaagcagtgctgggcagagcagccggaacttcggccctccatggaccacaccttcgacctgttcaagaacatcaacaagggccggaagacgaacatcattgactcgatgcttcggatgctggagcagtactctagtaacctggaggatctgatccgggagcacacggaggagctggagctggaaaagcagaagacagaccggctgcttacacagatgctgcctccgtctgtggctgaggccttgaagacggggacaccagtggagcccgagtactttgagcaagtgacactgtactttagtgacattgtgggcttcaccaccatctctgccatgagtgagcccattgaggttgtggacctgctcaacgatctctacacactctttgatgccatcattggttcccacgatgtctacaaggtggagacaataggggacgcctatatggtggcctcggggctgccccagcggaatgggcagcgacacgcggcagagatcgccaacatgtcactggacatcctcagtgccgtgggcactttccgcatgcgccatatgcctgaggttcccgtgcgcatccgcataggcctgcactcgggtccatgcgtggcaggcgtggtgggcctcaccatgccgcggtactgcctgtttggggacacggtcaacaccgcctcgcgcatggagtccaccgggctgccttaccgcatccacgtgaacttgagcactgtggggattctccgtgctctggactcgggctaccaggtggagctgcgaggccgcacggagctgaagggcaagggcgccgaggacactttctggctagtgggcagacgcggcttcaacaagcccatccccaaaccgcctgacctgcaaccggggtccagcaaccacggcatcagcctgcaggagatcccacccgagcggcgacggaagctggagaaggcgcggccgggccagttctcttgaaagcttgaattcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggaagccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5494 - RNA, 122 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuaaguacucugugcuggaaacagcacagaaucuacuuaaacaaggcaaaaugccguguuuaucucgucaacuuguuggcgagauuuuuu

SEQ ID NO: 5495 - RNA, 116 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuaaguacucugugcuggaaacagcacagaaucuacuuaaacaaggcaaaaugccguguuuaucucgucaacuuguuggcgaga

SEQ ID NO: 5496 - RNA, 124 nt, Artificial Sequence
  Chemically Synthesized
  misc_feature (1)..(30): n is a, c, g, u, or other and this region may encompass 17-30 nucleotides
  misc_feature (117)..(124): This region may encompass 1-8 uracil
nnnnnnnnnnnnnnnnnnnnnnnnnnnnnnguuuaaguacucugugcuggaaacagcacagaaucuacuuaaacaaggcaaaaugccguguuuaucucgucaacuuguuggcgagauuuuuuuu

SEQ ID NO: 5497 - RNA, 122 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuguaaugaaaauuacagaaucuacuaaaacaaggcaaaaugccguguuuaucucgucaacuuguuggcgagauuuuuuuu

SEQ ID NO: 5498 - RNA, 114 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuguaaugaaaauuacagaaucuacuaaaacaaggcaaaaugccguguuuaucucgucaacuuguuggcgaga

SEQ ID NO: 5499 - RNA, 122 nt, Artificial Sequence; identical to SEQ ID NO: 5497
  Chemically Synthesized
  misc_feature (1)..(30): n is a, c, g, u, or other and this region may encompass 17-30 nucleotides
  misc_feature (115)..(122): This region may encompass 1-8 uracil

SEQ ID NO: 5500 - RNA, 124 nt, Artificial Sequence; identical to SEQ ID NO: 5496
  Chemically Synthesized
  misc_feature (1)..(30): n is a, c, g, u, or other and this region may encompass 17-30 nucleotides

SEQ ID NO: 5501 - RNA, 116 nt, Artificial Sequence; identical to SEQ ID NO: 5495
  Chemically Synthesized
  misc_feature (1)..(30): n is a, c, g, u, or other and this region may encompass 17-30 nucleotides

SEQ ID NO: 5502 - RNA, 124 nt, Artificial Sequence; identical to SEQ ID NO: 5496
  Chemically Synthesized
  misc_feature (1)..(30): n is a, c, g, u, or other and this region may encompass 17-30 nucleotides
  misc_feature (117)..(124): This region may encompass 1-8 uracil

SEQ ID NO: 5503 - RNA, 110 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuggaaacagaaucuacuaaaacaaggcaaaaugccguguuuaucucgucaacuuguuggcgagauuuu

SEQ ID NO: 5504 - RNA, 106 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuggaaacagaaucuacuaaaacaaggcaaaaugccguguuuaucucgucaacuuguuggcgaga

SEQ ID NO: 5505 - RNA, 114 nt, Artificial Sequence
  Chemically Synthesized
  misc_feature (1)..(30): n is a, c, g, u, or other and this region may encompass 17-30 nucleotides
  misc_feature (107)..(114): This region may encompass 1-8 uracil
nnnnnnnnnnnnnnnnnnnnnnnnnnnnnnguuuuaguacucuggaaacagaaucuacuaaaacaaggcaaaaugccguguuuaucucgucaacuuguuggcgagauuuuuuuu

SEQ ID NO: 5506 - DNA, 3144 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggatctgatccgggagcacagttttagagctagaaatagcaagttaaaataaggctagtccgttatcaacttgaaaaagtggcaccgagtcggtgcttttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 5507 - DNA, 3144 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtctgatccgggagtacacgggttttagagctagaaatagcaagttaaaataaggctagtccgttatcaacttgaaaaagtggcaccgagtcggtgcttttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 5508 - DNA, 4917 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggcaccggtgccaccatggccccaaagaagaagcggaaggtcggatccggaggatctgatccgggagcacacggaggagctggaatcgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 5509 - DNA, 4912 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggcaccggtaggatctgatccgggagcacacggaggagctggagccaccatggccccaaagaagaagcggaaggtcggatccgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 5510 - DNA, 4933 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgctagccccggtgccaccatggccccaaagaagaagcggaaggtcggatccggaggatctgatccgggagcacacggaggagctggaatcgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 5511 - DNA, 4928 bp, Adeno-associated virus
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgctagccccggtaggatctgatccgggagcacacggaggagctggagccaccatggccccaaagaagaagcggaaggtcggatccgataagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagcgcttccagctcctccgtgtgctcccggatcagatcctccaagcttaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 5512 - DNA, 8866 bp, Artificial Sequence
  plasmid
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggtcttcgagaagacctgttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaaggaattcggcagtggagagggcagaggaagtctgctaacatgcggtgacgtcgaggagaatcctggcccaatggtagcaggtcatgcctctggcagccccgcattcgggaccgcctctcattcgaattgcgaacatgaagagatccacctcgccggctcgatccagccgcatggcgcgcttctggtcgtcagcgaacatgatcatcgcgtcatccaggccagcgccaacgccgcggaatttctgaatctcggaagcgtactcggcgttccgctcgccgagatcgacggcgatctgttgatcaagatcctgccgcatctcgatcccaccgccgaaggcatgccggtcgcggtgcgctgccggatcggcaatccctctacggagtactgcggtctgatgcatcggcctccggaaggcgggctgatcatcgaactcgaacgtgccggcccgtcgatcgatctgtcaggcacgctggcgccggcgctggagcggatccgcacggcgggttcactgcgcgcgctgtgcgatgacaccgtgctgctgtttcagcagtgcaccggctacgaccgggtgatggtgtatcgtttcgatgagcaaggccacggcctggtattctccgagtgccatgtgcctgggctcgaatcctatttcggcaaccgctatccgtcgtcgactgtcccgcagatggcgcggcagctgtacgtgcggcagcgcgtccgcgtgctggtcgacgtcacctatcagccggtgccgctggagccgcggctgtcgccgctgaccgggcgcgatctcgacatgtcgggctgcttcctgcgctcgatgtcgccgtgccatctgcagttcctgaaggacatgggcgtgcgcgccaccctggcggtgtcgctggtggtcggcggcaagctgtggggcctggttgtctgtcaccattatctgccgcgcttcatccgtttcgagctgcgggcgatctgcaaacggctcgccgaaaggatcgcgacgcggatcaccgcgcttgagagctaagctagcgaattctaactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaatcactacattcacatctgatttcagtagttccttacgagagttcctccgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggaagccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5513 - RNA, 21 nt, Artificial Sequence
  Chemically Synthesized
gaagagcacggcagcucuuca

SEQ ID NO: 5514 - DNA, 5491 bp, Artificial Sequence; identical to SEQ ID NO: 5468
  Plasmid

What is claimed is:

1. A method for editing a guanylate cyclase 2D (GUCY2D) gene comprising an R838H, R838C or R838S mutation, comprising:
   introducing into a human cell one or more *S. pyogenes* or *S. aureus* Cas9 endonucleases and one or more guide RNAs (gRNAs) comprising a spacer sequence selected from the group consisting of nucleic acid sequences in SEQ ID NOs: 5282-5313, 5398-5409 and 5434-5443,
   thereby effecting one or more single stranded breaks (SSBs) or double stranded breaks (DSBs) within or near the R838H, R838C or R838S mutation of the GUCY2D gene that results in an edited human cell.

2. The method of claim 1, wherein the edited human cell comprises a deletion, insertion or correction.

3. The method of claim 2, wherein the deletion, insertion or correction restores retinal membrane guanylate cyclase-1 (RetGC1) protein activity.

4. The method of claim 1, wherein the method comprises introducing into the human cell one or more polynucleotides encoding the one or more endonucleases.

5. The method of claim 1, wherein the one or more gRNAs are single-molecule guide RNAs (sgRNAs).

6. The method of claim 1, wherein the one or more endonucleases is pre-complexed with one or more gRNAs.

7. The method of claim 5, wherein the one or more endonucleases is pre-complexed with one or more sgRNAs.

8. The method of claim 1, further comprising introducing into the human cell a polynucleotide donor template comprising at least a portion of the wild-type GUCY2D gene, or cDNA.

9. A method for editing GUCY2D gene comprising an R838H mutation comprising:
   introducing into a human cell one or more *S. pyogenes* or *S. aureus* Cas9 endonucleases and one or more RNAs comprising a spacer sequence selected from the group consisting of nucleic acid sequences in SEQ ID NOs: 5282-5293, 5398-5409 and 5434-5443,
   thereby effecting one or more SSBs or double stranded breaks DSBs within or near the R838H mutation of the GUCY2D gene that results in an edited human cell.

10. The method of claim 9, wherein the edited human cell comprises a deletion, insertion or correction.

11. The method of claim 10, wherein the deletion, insertion or correction restores retinal membrane guanylate cyclase-1 (RetGC1) protein activity.

12. The method of claim 9, wherein the method comprises introducing into the human cell one or more polynucleotides encoding the one or more endonucleases.

13. The method of claim 9, wherein the one or more gRNAs are single-molecule guide RNAs (sgRNAs).

14. The method of claim 9, wherein the one or more endonucleases is pre-complexed with one or more gRNAs.

15. The method of claim 13, wherein the one or more endonucleases is pre-complexed with one or more sgRNAs.

16. The method of claim 9, further comprising introducing into the human cell a polynucleotide donor template comprising at least a portion of the wild-type GUCY2D gene, or cDNA.

* * * * *